US011959081B2

(12) United States Patent
Schlegel et al.

(10) Patent No.: US 11,959,081 B2
(45) Date of Patent: Apr. 16, 2024

(54) TRANSTHYRETIN (TTR) IRNA COMPOSITIONS AND METHODS OF USE THEREOF

(71) Applicant: Alnylam Pharmaceuticals, Inc., Cambridge, MA (US)

(72) Inventors: Mark K. Schlegel, Boston, MA (US); Adam Castoreno, Framingham, MA (US); James D. McIninch, Burlington, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 17/935,997

(22) Filed: Sep. 28, 2022

(65) Prior Publication Data
US 2023/0111813 A1 Apr. 13, 2023

Related U.S. Application Data

(63) Continuation of application No. PCT/US2022/039111, filed on Aug. 2, 2022.

(60) Provisional application No. 63/228,830, filed on Aug. 3, 2021.

(51) Int. Cl.
C07H 21/04 (2006.01)
A61K 31/713 (2006.01)
C12N 15/113 (2010.01)

(52) U.S. Cl.
CPC .......... *C12N 15/113* (2013.01); *A61K 31/713* (2013.01); *C12N 2310/315* (2013.01); *C12N 2310/322* (2013.01); *C12N 2310/351* (2013.01); *C12N 2320/30* (2013.01)

(58) Field of Classification Search
None
See application file for complete search history.

(56) References Cited

U.S. PATENT DOCUMENTS

| | | |
|---|---|---|
| 7,250,496 B2 | 7/2007 | Bentwich |
| 7,427,605 B2 | 9/2008 | Davis et al. |
| 7,718,629 B2 | 5/2010 | Bumcrot et al. |
| 8,168,775 B2 | 5/2012 | Sah et al. |
| 8,741,866 B2 | 6/2014 | Sah et al. |
| 9,101,643 B2 | 8/2015 | Sah |
| 9,228,186 B2 | 1/2016 | Khvorova et al. |
| 9,234,196 B2 | 1/2016 | Sah et al. |
| 9,339,513 B2 | 5/2016 | Gollob et al. |
| 9,399,775 B2 | 7/2016 | Rajeev et al. |
| 9,708,607 B2 | 7/2017 | Rajeev et al. |
| 9,777,270 B2 | 10/2017 | Khvorova et al. |
| 9,796,974 B2 | 10/2017 | Rajeev et al. |
| 10,060,921 B2 | 8/2018 | Bettencourt |
| 10,208,307 B2 | 2/2019 | Zimmermann et al. |
| 10,240,152 B2 | 3/2019 | Sah et al. |
| 10,570,391 B2 * | 2/2020 | Rajeev ............ C12N 15/1136 |
| 11,079,379 B2 | 8/2021 | Bettencourt |
| 11,286,486 B2 | 3/2022 | Zimmermann et al. |
| 2002/0160394 A1 | 10/2002 | Wu |
| 2003/0072794 A1 | 4/2003 | Boulikas |
| 2003/0124616 A1 | 7/2003 | Jacobsen et al. |
| 2003/0143732 A1 | 7/2003 | Fosnaugh et al. |
| 2003/0170891 A1 | 9/2003 | McSwiggen |
| 2003/0191056 A1 | 10/2003 | Walker et al. |
| 2003/0229037 A1 | 12/2003 | Massing et al. |
| 2004/0119010 A1 | 6/2004 | Perryman et al. |
| 2004/0259247 A1 | 12/2004 | Tuschl et al. |
| 2005/0244869 A1 | 11/2005 | Brown-Driver et al. |
| 2005/0276804 A1 | 12/2005 | Smith et al. |
| 2006/0008910 A1 | 1/2006 | MacLachlan et al. |
| 2006/0083780 A1 | 4/2006 | Heyes et al. |
| 2006/0135460 A1 | 6/2006 | Widder et al. |
| 2006/0240093 A1 | 10/2006 | MacLachlan et al. |
| 2006/0263435 A1 | 11/2006 | Davis et al. |
| 2007/0004664 A1 | 1/2007 | McSwiggen et al. |
| 2007/0031844 A1 | 2/2007 | Khvorova et al. |
| 2007/0135372 A1 | 6/2007 | MacLachlan et al. |
| 2007/0207974 A1 | 9/2007 | Khvorova et al. |
| 2007/0281899 A1 | 12/2007 | Bumcrot et al. |
| 2008/0188675 A1 | 8/2008 | Chen et al. |

(Continued)

FOREIGN PATENT DOCUMENTS

| | | |
|---|---|---|
| EP | 2305805 A1 | 4/2011 |
| WO | WO-2004/015107 A2 | 2/2004 |

(Continued)

OTHER PUBLICATIONS

Foster et al. ("Advanced siRNA designs further improve in vivo performance of GalNAc-siRNA conjugates." Molecular Therapy 26.3 (2018): 708-717).*
International Preliminary Report on Patentability from PCT/US2019/053050, dated Apr. 8, 2021.
Farnoodian et al., "Cell-autonomous lipid-handling defects in Stargardt iPSC-derived retinal pigment epithelium cells", Stem Cell Reports, vol. 17, 2438-2450, Nov. 8, 2022.
International Search Report and Written Opinion from PCT/US2022/039111, dated Nov. 22, 2022.
Brown et al., "Investigating the pharmacodynamic durability of GalNAc-siRNA conjugates", Nucleic Acids Research, 2020, vol. 48, No. 21 11827-11844.

(Continued)

*Primary Examiner* — Kimberly Chong
(74) *Attorney, Agent, or Firm* — McCarter & English, LLP; Maria Laccotripe Zacharakis; Miao Yu

(57) ABSTRACT

The present invention relates to RNAi agents, e.g., double stranded RNA (dsRNA) agents, targeting the transthyretin (TTR) gene. The invention also relates to methods of using such RNAi agents to inhibit expression of an TTR gene and to methods of preventing and treating an TTR-associated disorder, e.g., senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, and hyperthyroxinemia.

30 Claims, 2 Drawing Sheets
Specification includes a Sequence Listing.

(56) References Cited

U.S. PATENT DOCUMENTS

| | | |
|---|---|---|
| 2009/0023215 A1 | 1/2009 | Jessee et al. |
| 2009/0023673 A1 | 1/2009 | Manoharan et al. |
| 2009/0082300 A1 | 3/2009 | Brown-Driver et al. |
| 2009/0149403 A1 | 6/2009 | MacLachlan et al. |
| 2009/0239814 A1 | 9/2009 | Manoharan et al. |
| 2009/0247608 A1 | 10/2009 | Manoharan et al. |
| 2009/0291131 A1 | 11/2009 | MacLachlan et al. |
| 2010/0120893 A1 | 5/2010 | Sah et al. |
| 2010/0130588 A1 | 5/2010 | Yaworski et al. |
| 2010/0167267 A1 | 7/2010 | Schulzknappe et al. |
| 2010/0267069 A1 | 10/2010 | Kiernan et al. |
| 2010/0323381 A1 | 12/2010 | Bergen, III et al. |
| 2010/0324120 A1 | 12/2010 | Chen et al. |
| 2011/0015250 A1 | 1/2011 | Bumcrot et al. |
| 2011/0237646 A1 | 9/2011 | Smith et al. |
| 2011/0256175 A1 | 10/2011 | Hope et al. |
| 2011/0294868 A1 | 12/2011 | Monia et al. |
| 2012/0149109 A1 | 6/2012 | Brown-Driver et al. |
| 2012/0225927 A1 | 9/2012 | Sah et al. |
| 2012/0244207 A1 | 9/2012 | Fitzgerald et al. |
| 2012/0294905 A1 | 11/2012 | Sah |
| 2013/0197055 A1 | 8/2013 | Kamens et al. |
| 2013/0217756 A1 | 8/2013 | Cancilla et al. |
| 2013/0281510 A1 | 10/2013 | Ando et al. |
| 2014/0194493 A1 | 7/2014 | Sah et al. |
| 2014/0315835 A1 | 10/2014 | Rajeev et al. |
| 2016/0076029 A1 | 3/2016 | Ando et al. |
| 2016/0264963 A1 | 9/2016 | Sah et al. |
| 2016/0304870 A1 | 10/2016 | Brown et al. |
| 2016/0355817 A1 | 12/2016 | Rajeev et al. |
| 2017/0029817 A1 | 2/2017 | Zimmermann et al. |
| 2017/0096663 A1 | 4/2017 | Ando et al. |
| 2018/0119144 A1 | 5/2018 | Khvorova et al. |
| 2018/0171332 A1 | 6/2018 | Ando et al. |
| 2018/0320182 A1 | 11/2018 | Khvorova et al. |
| 2019/0309293 A1 | 10/2019 | Sah et al. |
| 2019/0345492 A1 | 11/2019 | Zimmermann et al. |
| 2019/0350962 A1 | 11/2019 | Chan et al. |
| 2020/0199592 A1 | 6/2020 | Ando et al. |
| 2020/0283766 A1 | 9/2020 | Sah et al. |
| 2020/0318111 A1 | 10/2020 | Rajeev et al. |
| 2021/0361692 A1 | 11/2021 | Gollob |
| 2022/0252593 A1 | 8/2022 | Bettencourt |
| 2022/0333104 A1 | 10/2022 | Nair et al. |

FOREIGN PATENT DOCUMENTS

| | | |
|---|---|---|
| WO | WO-2004/045543 A2 | 6/2004 |
| WO | WO-2004/080406 A2 | 9/2004 |
| WO | WO-2004/090108 A2 | 10/2004 |
| WO | WO-2005/120152 A2 | 12/2005 |
| WO | WO-2005/121370 A2 | 12/2005 |
| WO | WO-2007/012191 A1 | 2/2007 |
| WO | WO-2008/042973 A2 | 4/2008 |
| WO | WO-2009/002944 A1 | 12/2008 |
| WO | WO-2009/073809 A2 | 6/2009 |
| WO | WO-2009/086558 A1 | 7/2009 |
| WO | WO-2009/127060 A1 | 10/2009 |
| WO | WO-2009/134487 A2 | 11/2009 |
| WO | WO-2010/042877 A1 | 4/2010 |
| WO | WO-2010/048228 A2 | 4/2010 |
| WO | WO-2010/053572 A2 | 5/2010 |
| WO | WO-2010/054406 A1 | 5/2010 |
| WO | WO-2010/078536 A1 | 7/2010 |
| WO | WO-2010/088537 A2 | 8/2010 |
| WO | WO-2010/129709 A1 | 11/2010 |
| WO | WO-2010/144740 A1 | 12/2010 |
| WO | WO-2010/147992 | 12/2010 |
| WO | WO-2010/148013 A2 | 12/2010 |
| WO | WO-2011/056883 A1 | 5/2011 |
| WO | WO-2011/123468 A1 | 10/2011 |
| WO | WO-2011/139917 A1 | 11/2011 |
| WO | WO-2012/037254 A1 | 3/2012 |
| WO | WO-2012/064824 | 5/2012 |
| WO | WO-2012177906 A1 | 12/2012 |
| WO | WO-2013/075035 A1 | 5/2013 |
| WO | WO-2013074974 A2 | 5/2013 |
| WO | WO-2015/042564 A1 | 3/2015 |
| WO | WO-2015/085158 A1 | 6/2015 |
| WO | WO-2016028649 A1 | 2/2016 |
| WO | WO-2016/033326 A2 | 3/2016 |
| WO | WO-2017/023660 A1 | 2/2017 |
| WO | WO-2018112320 | 12/2017 |
| WO | WO-2019/060442 | 3/2019 |
| WO | WO-2020/069055 A1 | 4/2020 |
| WO | WO-2021/041884 | 3/2021 |
| WO | WO-2021/092145 | 5/2021 |
| WO | WO-2021/178778 | 9/2021 |
| WO | WO-2022/235537 A1 | 11/2022 |

OTHER PUBLICATIONS

U.S. Appl. No. 17/371,182, filed Jul. 9, 2021, Pending.
U.S. Appl. No. 17/584,463, filed Jan. 26, 2022, Pending.
U.S. Appl. No. 17/213,294, filed Mar. 26, 2021, Pending.
U.S. Appl. No. 17/736,251, filed May 4, 2022, Pending.
U.S. Appl. No. 17/899,957, filed Aug. 31, 2022, Pending.
U.S. Appl. No. 17/672,771, filed Feb. 16, 2022, Pending.
U.S. Appl. No. 17/102,351, filed Nov. 23, 2020, Abandoned.
U.S. Appl. No. 17/234,657, filed Apr. 19, 2021, Abandoned.
U.S. Appl. No. 17/360,849, filed Jun. 28, 2021, Abandoned.
U.S. Appl. No. 17/475,142, filed Sep. 14, 2021, Abandoned.
U.S. Appl. No. 17/721,704, filed Apr. 15, 2022, Pending.
U.S. Appl. No. 17/362,631, filed Jun. 29, 2021, Abandoned.
Ando Y., et al., "Pathogenesis and Therapy for Transthyretin Related Amyloidosis," Rinsho byori (the Japanese journal of clinical pathology), Feb. 2008, pp. 114-120, vol. 56 (With English Abstract).
Hornung V, et al., "Sequence-specific potent induction of IFN-α by short interfering RNA in plasmacytoid dendritic cells through TLR7". Nature Medicine, Mar. 2005, pp. 263-270, vol. 11, No. 3.
Judge A., et al., Confirming the RNAi-mediated mechanism of action of siRNA-based cancer therapeutics in mice. The Journal of Clinical Investigation, 2009 119(3): 661-673.
Elbashir S, et al., Analysis of gene function in somatic mammalian cells using small interfering RNAs. Methods, 2002 pp. 199-213, vol. 26.
Elbashir S, et al., Duplexes of 21-nucleotide RNAs mediate RNA interference in mammalian cell culture. Nature, May 24, 2001, pp. 494-498, vol. 411.
Akinc A., et al., A combinatorial library of lipid-like materials for delivery of RNAi therapeutics. Nature Biotechnology, 2008, vol. 26, pp. 561-569.
Agrawal, S., et al., "Antisense oligonucleotides: towards clinical trials." Trends in Biotechnology. Oct. 1996, vol. 14, pp. 376-387.
Bass, B., "The short answer," Nature, May 24, 2001, pp. 428-429, vol. 411.
Elbashir, S., et al., "Functional Anatomy of siRNAs for Mediating Efficient RNAi in *Drosophila melanogaster* Embryo Lysate", The EMBO Journal, 2001, pp. 6877-6888, vol. 20, No. 23.
Elbashir S, et al., RNA Interference id Mediated by 21- and 22 Nucleotide RNAs. Genes & Development, 2001, pp. 188-200, vol. 15.
Fire, A., "RNA-triggered Gene Silencing," Trends in Genetics, Sep. 1999, pp. 358-363, vol. 15, No. 9.
Fire A., at al., Potent and Specific Genetic Interference by Double Stranded RNA in Caenorhabditis elegans. Nature, Feb. 19, 1998, pp. 806-811, vol. 391.
Heyes J., et al., Cationic lipid saturation influences intracellular delivery of encapsulated nucleic acids. Journal of Controlled Release, 2005, pp. 276-287, vol. 107.
Kurosawa T., et al., Selective silencing of a mutant transthyretin allele by small interfering RNAs. Biochem. Biophys. Res. Commun., Nov. 25, 2005, vol. 337, No. 3, pp. 1012-1018.
Love K., et al., Lipid-like materials for low-dose, in vivo gene silencing. PNAS, Feb. 2, 2010, pp. 1864-1869, vol. 107, No. 5.
Maeda S., Use of genetically altered mice to study the role of serum amyloid P component in amyloid deposition. Amyloid, 2003, vol. 10, Suppl 1, pp. 17-20.

(56) References Cited

OTHER PUBLICATIONS

Morrissey D., et al., Potent and persistent in vivo anti-HBV activity of chemically modified siRNAs. Nature Biotechnology, Aug. 1, 2005, vol. 23, pp. 1002-1007.
Reynolds, et al., Rational siRNA design for RNA interference. Nature Biotechnology, vol. 22, No. 3, pp. 326-330, 2004.
Robbins M., et al., Stable expression of shRNAs in human CD34 progenitor cells can avoid induction of interferon responses to siRNAs in vitro. Nature Biotechnology, May 2006, pp. 566-571, vol. 24, No. 5.
Rose S., et al., Functional polarity is introduced by Dicer processing of short substrate RNAs. Nucleic Acids Research, 2005, pp. 4140-4156, vol. 33, No. 13.
Stein T., et al., Neutralization of transthyretin reverses the neuroprotective effects of secreted amyloid precursor protein (APP) in APP sw mice resulting in Tau phosphorylation and loss of Hippocampal neurons: support for the amyloid hypothesis. The Journal of Neuroscience, Sep. 1, 2004, vol. 24, No. 35, pp. 7707-7717.
Tuschl T., RNA Interference and Small Interfering RNAs. Chembiochem, 2001 pp. 39-245, vol. 2.
Tuschl T., et al., Small Interfering RNAs: A Revolutionary Tool for the Analysis of Gene Function and Gene Therapy. Molecular Interventions, 2002, pp. 158-167, vol. 2, No. 3.
Tuschl T., Mammalian RNA Interference. RNAi, A Guide to Gene Silencing, Chapter 13, G.J. Hannon (ed.), 2003, pp. 265-295.
Tuschl, T., et al., "Targeted mRNA Degradation by Double-Stranded RNA In Vitro," Genes & Development, 1999, pp. 3191-3197, vol. 13.
Vickers T., et al., Efficient Reduction of Target RNAs by Small Interfering RNA and RNase H-dependent Antisense Agents. The Journal of Biological Chemistry, Feb. 28, 2003, pp. 7108-7118, vol. 278, No. 9.
Weil et al., Targeting the Kinesin Eg5 to Monitor siRNA Transfection in Mammalian Cells. Biotechniques, 2002, vol. 33, No. 6, pp. 1244-1248.
Prakash TP, et al., Positional Effect of Chemical Modifications on Short INterference RNA Activity in Mammalian Cells. J. Med. Chem. 48:4247-4253 (2005).
Collingwood MA., et al., Chemical Modification Patterns Compatible with High Potency Dicer-Substrate Small Interfering RNAs. Oliginucleotides, 18:187-200 (2008).
Bramsen JB, et al., A Large-Scale Chemical Modification Screen Identifies Design Rules to Generate siRNAs with High Activity, High Stability and Low Toxicity, Nucleic Acids Res. 37(9):2867-2881 (2009).
DeLeavey GF, et al., Synergistic Effects Between Analogs of DNA and RNA Improve the Potency of siRNA-Mediated Gene Silencing, Nucleic Acids Res. 38(13):4547-4557 (2010).
Ueda M, et al., SELDI-TOF mass spectrometry evaluation of variant transthyretins for diagnosis and pathogenesis of familial amyloidotic polyneuropathy. Clin. Chem 2009; 55(6):1223-1227; abstract, Table 1.
Schweigert FJ, et al., Characterization of the microheterogeneity of traansthyretin in plasma and urine using SELDI-TOF-MS immunoassay. Proteome Sci. 2004, 2(1) article 5, pp. 1-6.
Berquist J, et al., Rapid Method to Characterize Mutations in Transthyretin in Cerebrospinal Fluid from Familial Amyloidotic Polyneuropathy Patients by Use of Matrix-assisted Laser Desorption/Ionization Time-of-Flight Mass Spectrometry. Clinical Chem. 2000, 46(9):1293-1300.
Hara R, et al., Impact of Liver Transplantation on Transthyretin-Related Ocular Amyloidosis in Japanese Patients. Arch Ophthalmol, Feb. 2010, pp. 206-210, vol. 128, No. 2.
Ueda M, et al., A transgenic rat with the human ATTR V30M: A novel tool for analysis of ATTY metabolisms. Biochemical and Biophysical Research Communications, 2006, pp. 299-304, vol. 352.
PCT International Search Report and Written Opinion, PCT/US2011/030392, dated Jun. 27, 2011, 10 pages.

Cendron L, et al., Amyloidogenic potential of transthyretin variants: insights from structural and computational analyses. J Biol Chem. Sep. 18, 2009;284(38):25832-41.
Trenchevska, et al., Mass spectrometric immunoassay for quantitative determination of transthyretin and its variants. Proteomics Aug. 9, 2011, 11(18):3633-3641; abstract p. 3633, para 1; p. 3634, para 5-6; p. 3635, para 1-4; p. 3636, para 2-3; p. 3637, para 2; p. 3639, para 3; Table 4; Figs 2-3.
Supplementary European Search Report for European Patent Application No. 10829034, dated Aug. 30, 2013, 9 pages.
Sekijima Y., et al., Pathogensis of and Therapeutic Strategies to Ameliorate the Transthyretin Amyloidoses. Current Pharmaceutical Design, Jan. 1, 2008, pp. 3219-3230, vol. 14, No. 30.
Benson M., et al., Targeted suppression of an amyloidogenic transthyretin with antisense oligonucleotides. Muscle & Nerve, Jan. 18, 2006, pp. 609-618, vol. 33, No. 5.
European Patent Office Communication pursuant to Article 94(3) EPC for European Patent Application No. 09 810 834.3, dated Feb. 15, 2012.
Examination Report for New Zealand Patent Application No. 592867, dated Jun. 14, 2011, 2 pages.
GenBank Accession No. NM_000371.3, *Homo sapiens* transthyretin (TTR), mRNA, Sep. 23, 2012.
GenBank Accession No. NM_000371.2, *Homo sapiens* transthyretin (TTR), mRNA, Dec. 21, 2008.
GenBank Accession No. NM_012681.1, Rattus norvegicus transthyretin (Ttr), mRNA, Feb. 14, 2010.
GenBank Accession No. NM_013697.2, Mus musculus transthyretin (Ttr), mRNA, Apr. 5, 2007.
PCT International Search Report and Written Opinion for International Patent Application No. PCT/US2010/055311, dated Mar. 2, 2011, 12 pages.
PCT International Search Report and Written Opinion for International Patent Application No. PCT/US2009/061381, dated Jul. 26, 2010.
Tuschl T., Functional genomics: RNA sets the standard. Nature, Hanuary 16, 2003, vol. 421, No. 6920, pp. 220-221.
The State Intellectual Property Office of the People's Republic of China, Notification of the First Office Action, Chinese Patent Application No. 200980141740.4, dated Jun. 5, 2012.
Tuschl, T., "Expanding small RNA interference," Nature Biotechnology, May 2002, pp. 446-448, vol. 20.
Zimmerman TS., et al., RNAi-mediated gene silencing in non-human primates. Nature, May 4, 2006, vol. 441, pp. 111-114.
PCT Invitation to Pay Additional Fees and, Where Applicable, Protest Fee, PCT/US2009/061381, dated Apr. 27, 2010, 7 Pages.
International Search Report for International Application No. PCT/US2012/065407 dated Apr. 22, 2013.
Smith et al., "Knockdown of cortical transthyretin expression around implanted neural prosthetic devices using intraventricular siRNA injection in the brain", Journal of Neuroscience Methods, vol. 203(2), pp. 398-406 (2011).
WY Sah Dinah et al., "802: ALN-TTR, an RNAI Therapeutic for the Treatment of Transthyretin Amyloidosis", Nucleic Acid Therapeutics, vol. 21(5), pp. A55-A56 ( Oct. 2011).
European Search Report from European Patent Application No. 12850255.6, dated May 11, 2015.
Kawasaki et al. "Synthesis, hybridization, and nuclease resistance properties of 2'-O-aminooxyethyl (2'-O-AOE) modified oligonucleotides", Tetrahedron Letters, 1999, 40, 661-664.
Czauderna et al.,"Structural variations and stabilising modifcations of synthetic siRNAs in mammalian cells", Nucleic Acids Research, 31(11)2705-2716, 2003.
Behlke, "Chemical Modification of siRNAs for In Vivo Use", Oligonucleotides, 18(4) 305-320 2008.
Extended European Search Report from EO 17184486.3 dated Jan. 29, 2018.
Chen et al. "Lipophilic siRNAs mediate efficient gene silencing in oligodendrocytes with direct CNS delivery", Journal of Controlled Release (2010).
Nakamura et al., "Targeted Conversion of the Transthyretin Gene in Vitro and in Vivo", Gene Therapy (2004) 11, 838-846.

(56) References Cited

OTHER PUBLICATIONS

Manoharan, "RNA interference and chemically modified small interfering RNAs", Current Opinion in Chemical Biology 2004, 8:570-579.
Gambari et a;. "Targeting microRNAs involved in human diseases: A novel approach for modification of gene expression and drug development", Biochemical Pharmacology 82 (2011) 1416-1429.
Alnylam Pharmaceuticals Discontinues Revusiran Development, Press Release, Oct. 5, 2016.
International Search Report and Written Opinion from PCT/US2016/044359 dated Nov. 7, 2016.
Behlke, "Chemical Modification of siRNAs for In Vivo Use", Oligonucleotides 18:305-320 (2008).
Reynolds et al., "Rational siRNA design for RNA interference," Nature Biotechnology, vol. 22, pp. 326-330, 2004.
Conceição et al. "Early diagnosis of ATTR amyloidosis through targeted follow-up of identified carries of TTR gene mutations," Amyloid, vol. 26, No. 1, pp. 3-9 (2019).
Coelho et al., "Safety and Efficacy of RNAi Therapy for Transthyretin Amyloidosis", N Engl J Med 2013; 369:819-829.
Butler et al., "Preclinical evaluation of RNAi as a treatment for transthyretin-mediated amyloidosis", Amyloid, 2016; 23(2): 109-118.
Salim et al., "Effective carrier-free gene-silencing activity of cholesterol-modified siRNAs", RSC Adv., 2018, 8, 22963.

\* cited by examiner

TRANSTHYRETIN (TTR) IRNA COMPOSITIONS AND METHODS OF USE THEREOF

RELATED APPLICATION

This application is a 35 § U.S.C. 111(a) continuation application which claims the benefit of priority to PCT/US2022/039111, filed on Aug. 2, 2022, which, in turn, claims the benefit of priority to U.S. Provisional Application No. 63/228,830, filed on Aug. 3, 2021. The entire contents of each of the foregoing applications are incorporated herein by reference.

SEQUENCE LISTING

The instant application contains a Sequence Listing which has been filed electronically in XML file format and is hereby incorporated by reference in its entirety. Said XML copy, created on Oct. 6, 2023, is named 121301_016502_SL.xml and is 4,198,690 bytes in size.

BACKGROUND OF THE INVENTION

Transthyretin (TTR) (also known as prealbumin) is found in serum and cerebrospinal fluid (CSF). TTR transports retinol-binding protein (RBP) and thyroxine (T4) and also acts as a carrier of retinol (vitamin A) through its association with RBP in the blood and the CSF. Transthyretin is named for its transport of thyroxine and retinol. TTR also functions as a protease and can cleave proteins including apoA-I (the major HDL apolipoprotein), amyloid 0-peptide, and neuropeptide Y. See Liz, M. A. et al. (2010) *IUBMB Life*, 62(6):429-435.

TTR is a tetramer of four identical 127-amino acid subunits (monomers) that are rich in beta sheet structure. Each monomer has two 4-stranded beta sheets and the shape of a prolate ellipsoid. Antiparallel beta-sheet interactions link monomers into dimers. A short loop from each monomer forms the main dimer-dimer interaction. These two pairs of loops separate the opposed, convex beta-sheets of the dimers to form an internal channel.

The liver is the major site of TTR expression. Other significant sites of expression include the choroid plexus, retina (particularly the retinal pigment epithelium) and pancreas.

Transthyretin is one of at least 27 distinct types of proteins that is a precursor protein in the formation of amyloid fibrils. See Guan, J. et al. (Nov. 4, 2011) Current perspectives on cardiac amyloidosis, *Am J Physiol Heart Circ Physiol*, doi:10.1152/ajpheart.00815.2011. Extracellular deposition of amyloid fibrils in organs and tissues is the hallmark of amyloidosis. Amyloid fibrils are composed of misfolded protein aggregates, which may result from either excess production of or specific mutations in precursor proteins. The amyloidogenic potential of TTR may be related to its extensive beta sheet structure; X-ray crystallographic studies indicate that certain amyloidogenic mutations destabilize the tetrameric structure of the protein. See, e.g., Saraiva M. J. M. (2002) *Expert Reviews in Molecular Medicine*, 4(12): 1-11.

Amyloidosis is a general term for the group of amyloid diseases that are characterized by amyloid deposits. Amyloid diseases are classified based on their precursor protein; for example, the name starts with "A" for amyloid and is followed by an abbreviation of the precursor protein, e.g., ATTR for amyloidogenic transthyretin. Ibid.

There are numerous TTR-associated diseases, most of which are amyloid diseases. Normal-sequence TTR is associated with cardiac amyloidosis in people who are elderly and is termed senile systemic amyloidosis (SSA) (also called senile cardiac amyloidosis (SCA) or cardiac amyloidosis). SSA often is accompanied by microscopic deposits in many other organs. TTR amyloidosis manifests in various forms. When the peripheral nervous system is affected more prominently, the disease is termed familial amyloidotic polyneuropathy (FAP). When the heart is primarily involved but the nervous system is not, the disease is called familial amyloidotic cardiomyopathy (FAC). A third major type of TTR amyloidosis is leptomeningeal amyloidosis, also known as leptomeningeal or meningocerebrovascular amyloidosis, central nervous system (CNS) amyloidosis, or amyloidosis VII form. Mutations in TTR may also cause amyloidotic vitreous opacities, carpal tunnel syndrome, and euthyroid hyperthyroxinemia, which is a non-amyloidotic disease thought to be secondary to an increased association of thyroxine with TTR due to a mutant TTR molecule with increased affinity for thyroxine. See, e.g., Moses et al. (1982) *J. Clin. Invest.*, 86, 2025-2033.

Abnormal TTR alleles may be either inherited or acquired through somatic mutations. Guan, J. et al. (Nov. 4, 2011) Current perspectives on cardiac amyloidosis, *Am J Physiol Heart Circ Physiol*, doi:10.1152/ajpheart.00815.2011. Transthyretin associated ATTR is the most frequent form of hereditary systemic amyloidosis. Lobato, L. (2003) *J. Nephrol.*, 16:438-442. TTR mutations accelerate the process of TTR amyloid formation and are the most important risk factor for the development of ATTR. More than 85 amyloidogenic TTR variants are known to cause systemic familial amyloidosis. TTR mutations usually give rise to systemic amyloid deposition, with particular involvement of the peripheral nervous system, although some mutations are associated with cardiomyopathy or vitreous opacities. Ibid.

The V30M mutation is the most prevalent TTR mutation. See, e.g., Lobato, L. (2003) *J Nephrol*, 16:438-442. The V122I mutation is carried by 3.9% of the African American population and is the most common cause of FAC. Jacobson, D. R. et al. (1997) *N. Engl. J. Med.* 336 (7): 466-73. It is estimated that SSA affects more than 25% of the population over age 80. Westermark, P. et al. (1990) *Proc. Natl. Acad. Sci. U.S.A.* 87 (7): 2843-5.

Additional TTR-associated diseases include ocular diseases, e.g., Stargardt's disease, diabetic retinopathy, age-related macular degeneration (AMD), e.g., dry AMD and wet AMD; metabolic disorders, e.g., disorders of glucose and lipid homeostasis, e.g., insulin resistance associated with type II diabetes, and cardiovascular disease.

For example, a primary pathological defect in the heritable eye disorder Stargardt disease is excessive accumulation of cytotoxic lipofuscin bisretinoids in the retina. Age-dependent accumulation of lipofuscin in the retinal pigment epithelium (RPE) matches the age-dependent increase in the incidence of the atrophic (dry) form of age-related macular degeneration (AMD) and, therefore, is a key pathogenic factor contributing to AMD progression. Lipofuscin bisretinoid synthesis in the retina depends on the influx of serum retinol from the circulation into the RPE and formation of the tertiary retinol-binding protein 4 (RBP4)-transthyretin-retinol complex in the serum is required for this influx. Knocking down the expression of TTR, which regulates RBP4, has been shown to result in a significant drop in both the RBP4 level and the amount of retinol being delivered to the target tissue, thereby inhibiting the formation of lipofuscin bisretinoids.

In addition, elevated RBP4 in the circulation of type 2 diabetic patients was reported many years ago (Basualdo C, et al., (1997). *J. Am. Coll. Nutr.* 16, 39-45; Abahusain et al., (1999). *Eur. J. Clin. Nutr.* 53, 630-635) and transgenic overexpression of RBP4 or injection of human RBP4 in normal mice were shown to cause insulin resistance. In contrast, genetic deletion of RBP4 or lowering of circulating RBP4 levels had the opposite effect and protected mice from developing insulin resistance (Yang, Q., et al. (2005). *Nature* 436, 356-362). In addition, positive associations were documented for circulating RBP4 or RBP4 expression levels with established cardiovascular disease (CVD) risk factors, including metabolic syndrome, overall/central obesity, dyslipidemia, inflammatory markers, and hypertension (Qi Q, et al., *J Clin Endocrinol Metab.* 2007; 92:4827-4834; Ingelsson E, et al., *Atherosclerosis*. 2009; 206:239-244). As indicated above, TTR regulates RBP4 and, thus, decreasing TTR results in a decrease in RBP4.

Any available current treatments for TTR-associated diseases such ocular diseases, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease, are not fully effective and may result in serous side effects, such as conjunctival hemorrhage, increased eye pressure, infection, retinal detachment and eye inflammation. Similarly, current treatments for metabolic diseases, including dieting, exercise, and medications to help control blood pressure, cholesterol and blood sugar levels, are not always effective.

Accordingly, there is a need in the art for effective treatments for TTR-associated diseases.

SUMMARY OF THE INVENTION

The present invention provides iRNA compositions which effect the RNA-induced silencing complex (RISC)-mediated cleavage of RNA transcripts of a gene encoding transthyretin (TTR). The TTR gene may be within a cell, e.g., a cell within a subject, such as a human subject. The present invention also provides methods of using the iRNA compositions of the invention for inhibiting the expression of an TTR gene and/or for treating a subject who would benefit from inhibiting or reducing the expression of an TTR gene, e.g., a subject suffering or prone to suffering from an TTR-associated disorder, e.g., senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease.

Accordingly, in one aspect, the invention provides a double stranded ribonucleic acid (dsRNA) agent for inhibiting expression of transthyretin (TTR) in a cell, wherein the dsRNA agent comprises a sense strand and an antisense strand forming a double stranded region, wherein the sense strand comprises at least 15, e.g., 15, 16, 17, 18, 19, 20, or 21, contiguous nucleotides differing by no more than 3, e.g., 3, 2, 1, or 0, nucleotides from the nucleotide sequence of 5'-AGAGTAUUCCAUUUUUACU-3' (SEQ ID NO:11) and the antisense strand comprises at least 15, e.g., 15, 16, 17, 18, 19, 20, 21, 22, or 23, contiguous nucleotides differing by no more than 3, e.g., 3, 2, 1, or 0, nucleotides from the nucleotide sequence of 5'-AGUAAAAAUGGAAUACUC-UUG-3'(SEQ ID NO:12), wherein all of the nucleotides of the sense strand and all of the nucleotides of the antisense strand comprise a nucleotide modification selected from the group consisting of a 2'-O-methyl modification and a 2'-fluoro modification; wherein the sense strand comprises at least 2 2'-fluoro modifications; wherein the antisense strand comprises at least 2 2'-fluoro modifications; wherein the sense strand comprises two phosphorothioate linkages; wherein the antisense strand comprises four phosphorothioate linkages; and wherein at least one strand is conjugated to a ligand.

In one embodiment, the sense strand comprises 2-6 2'-fluoro modifications.

In one embodiment, the sense strand comprises 4 2'-fluoro modifications.

In one embodiment, the 4 2'-fluoro modifications are located at positions 7 and 9-11 from the 5'-end of the sense strand.

In one embodiment, the sense strand comprises 3 2'-fluoro modifications.

In one embodiment, the 3 2'-fluoro modifications are located at positions 7-9 from the 5'-end of the sense strand.

In one embodiment, the antisense strand comprises 2-6 2'-fluoro modifications.

In one embodiment, the antisense strand comprises 4 2'-fluoro modifications.

In one embodiment, the 4 2'-fluoro modifications are located at positions 2, 6, 14, and 16 from the 5'-end of the antisense strand.

In one embodiment, the antisense strand comprises 2 2'-fluoro modifications.

In one embodiment, the 2 2'-fluoro modifications are located at positions 14 and 16 from the 5'-end of the antisense strand.

In one embodiment, the sense strand comprises two phosphorothioate internucleotide linkages between the 5' end three terminal nucleotides.

In one embodiment, the antisense strand comprises two phosphorothioate internucleotide linkages between the 3'-end three terminal nucleotides and two phosphorothioate internucleotide linkages between the 5' end three terminal nucleotides.

In one embodiment, the ligand is conjugated to the 3' end of the sense strand of the dsRNA agent.

In one embodiment, the ligand is an N-acetylgalactosamine (GalNAc) derivative.

In one embodiment, the ligand is one or more GalNAc derivatives attached through a monovalent, bivalent, or trivalent branched linker.

In one embodiment, the ligand is

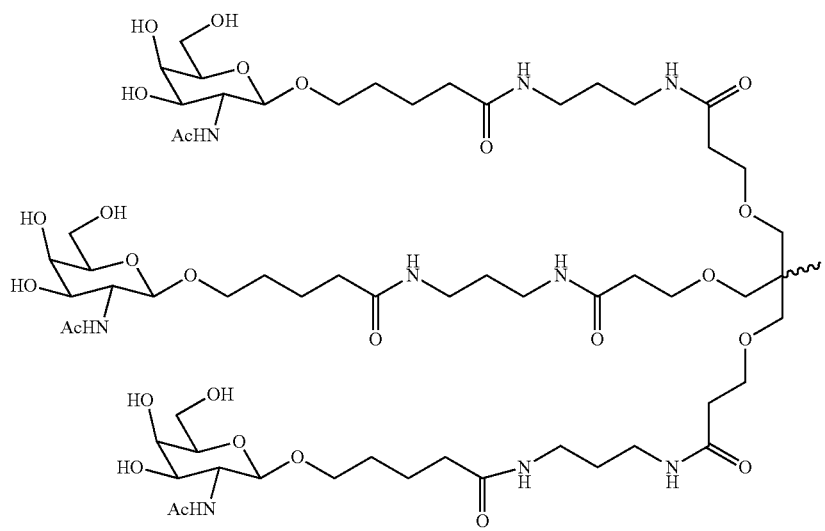 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the dsRNA agent is conjugated to the ligand as shown in the following schematic

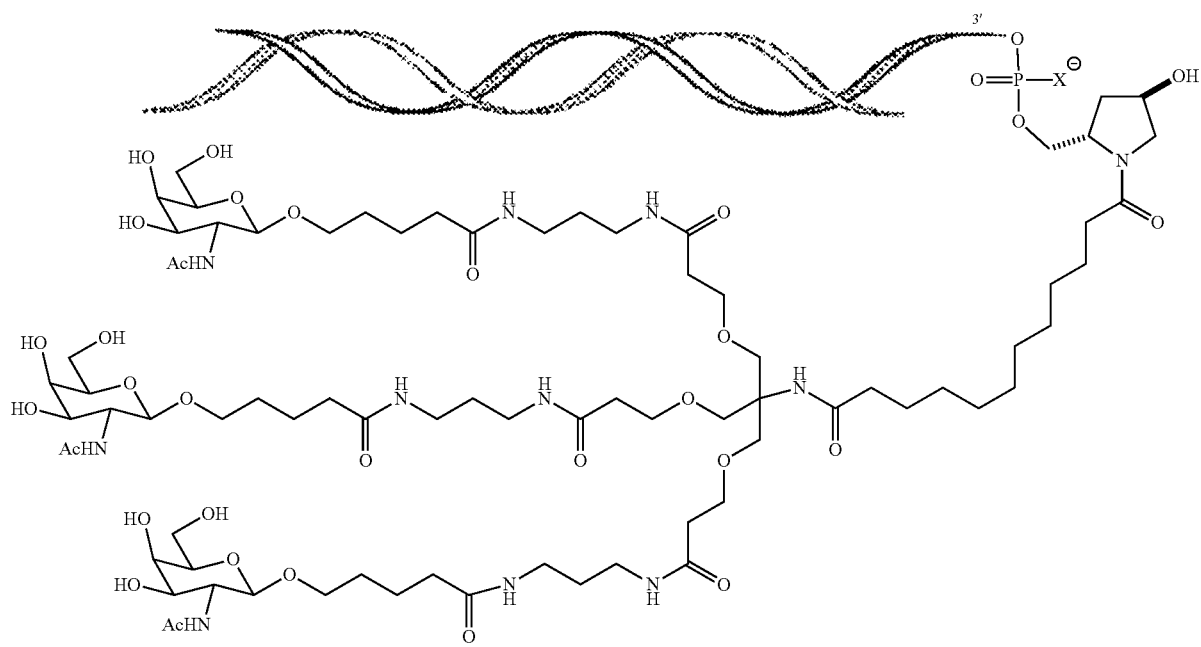

and, wherein X is O or S.

In one embodiment, the X is O.

In one embodiment, the double stranded region is 19-30 nucleotide pairs in length.

In one embodiment, the double stranded region is 19-25 nucleotide pairs in length.

In one embodiment, the double stranded region is 19-23 nucleotide pairs in length.

In one embodiment, the double stranded region is 23-27 nucleotide pairs in length.

In one embodiment, the double stranded region is 21-23 nucleotide pairs in length.

In one embodiment, each strand is independently no more than 30 nucleotides in length.

In one embodiment, the sense strand is 21 nucleotides in length and the antisense strand is 23 nucleotides in length.

In one embodiment, at least one strand comprises a 3' overhang of at least 1 nucleotide.

In one embodiment, at least one strand comprises a 3' overhang of at least 2 nucleotides.

In one embodiment, the sense strand comprises the nucleotide sequence 5'-CAAGAGUAUUC-CAUUUUUACU-3' (SEQ ID NO: 13) and the antisense strand comprises the nucleotide sequence 5'-AGUAAAAAUGGAAUACUCUUGGU-3' (SEQ ID NO: 18).

In one embodiment, the sense strand comprises the nucleotide sequence 5'-CCAAGAGUAUUC-CAUUUUUAU-3' (SEQ ID NO: 19) and the antisense strand comprises the nucleotide sequence 5'-AUAAAAAUGGAAUACUCUUGGUU-3' (SEQ ID NO: 20).

In one embodiment, the nucleotide sequence of the sense strand differs by no more than 4 bases form the nucleotide sequence of 5'-csasagagUfaUfUfCfcauuuuuacu-3'(SEQ ID NO: 21) and the nucleotide sequence of the antisense strand differs by no more than 4 bases from the nucleotide sequence of 5'-asGfsuaaAfaauggaaUfaCfucuugsgsu-3'(SEQ ID NO: 22), wherein a, c, g, and u are 2'-O-methyl (2'-OMe) A, C, G, and U; Af, Cf, Gf and Uf are 2'-fluoro A, C, G and U; and s is a phosphorothioate linkage.

In one embodiment, the nucleotide sequence of the sense strand differs by no more than 3 bases form the nucleotide sequence of 5'-csasagagUfaUfUfCfcauuuuuacu-3'(SEQ ID NO: 21) and the nucleotide sequence of the antisense strand differs by no more than 3 bases from the nucleotide sequence of 5'-asGfsuaaAfaauggaaUfaCfucuugsgsu-3'(SEQ ID NO: 22).

In one embodiment, the nucleotide sequence of the sense strand differs by no more than 2 bases form the nucleotide sequence of 5'-csasagagUfaUfUfCfcauuuuuacu-3'(SEQ ID NO: 21) and the nucleotide sequence of the antisense strand differs by no more than 2 bases from the nucleotide sequence of 5'-asGfsuaaAfaauggaaUfaCfucuugsgsu-3'(SEQ ID NO: 22).

In one embodiment, the nucleotide sequence of the sense strand differs by no more than 1 base form the nucleotide sequence of 5'-csasagagUfaUfUfCfcauuuuuacu-3' (SEQ ID NO: 21) and the nucleotide sequence of the antisense strand differs by no more than 1 base from the nucleotide sequence of 5'-asGfsuaaAfaauggaaUfaCfucuugsgsu-3'(SEQ ID NO: 22).

In one embodiment, the sense strand comprises the nucleotide sequence of 5'-csasagagUfaUfUfCfcauuuuuacu-3'(SEQ ID NO: 21) and the antisense strand comprises the nucleotide sequence of 5'-asGfsuaaAfaauggaaUfaCfucuugsgsu-3'(SEQ ID NO: 22).

In one embodiment, the sense strand consists of the nucleotide sequence of 5'-csasagagUfaUfUfCfcauuuuuacu-3'(SEQ ID NO: 21) and the antisense strand consists of the nucleotide sequence of 5'-asGfsuaaAfaauggaaUfaCfucuugsgsu-3'(SEQ ID NO: 22).

In one embodiment, the sense strand comprises the nucleotide sequence of 5'-csasagagUfaUfUfCfcauuuuua-cuL96-3' (SEQ ID NO:33) and the antisense strand comprises the nucleotide sequence of 5'-asGfsuaaAfaauggaaU-faCfucuugsgsu-3'(SEQ ID NO: 22, wherein L96 is N-[tris(GalNAc-alkyl)-amidodecanoyl)]-4-hydroxyprolinol.

In one embodiment, the dsRNA agent is conjugated to the ligand as shown in the following schematic

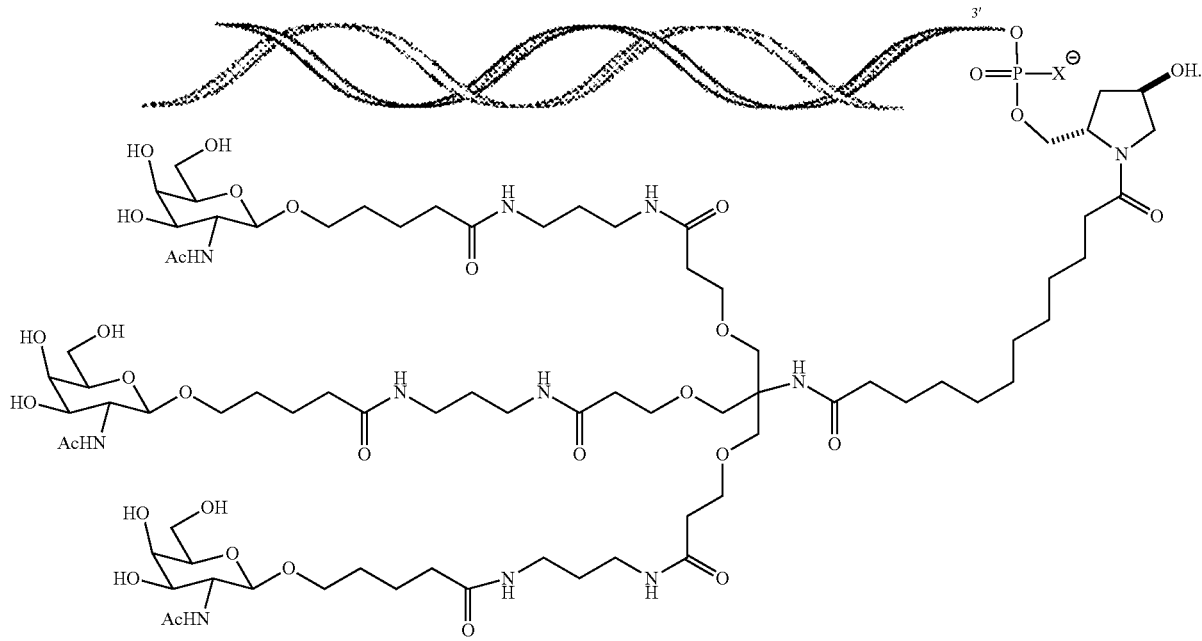

wherein X is O.

In one embodiment, the nucleotide sequence of the sense strand differs by no more than 4 bases form the nucleotide sequence of 5'-cscsaagaGfuAfUfUfccauuuuuau-3'(SEQ ID NO:35) and the nucleotide sequence of the antisense strand differs by no more than 4 bases from the nucleotide sequence of 5'-asUfsaaaAfauggaauAfcUfcuuggsusu-3'(SEQ ID NO:36), wherein a, c, g, and u are 2'-O-methyl (2'-OMe) A, C, G, and U; Af, Cf, Gf and Uf are 2'-fluoro A, C, G and U; and s is a phosphorothioate linkage.

In one embodiment, the nucleotide sequence of the sense strand differs by no more than 3 bases form the nucleotide sequence of 5'-cscsaagaGfuAfUfUfccauuuuuau-3' (SEQ ID NO:35) and the nucleotide sequence of the antisense strand differs by no more than 3 bases from the nucleotide sequence of 5'-asUfsaaaAfauggaauAfcUfcuuggsusu-3'(SEQ ID NO:36).

In one embodiment, the nucleotide sequence of the sense strand differs by no more than 2 bases form the nucleotide sequence of 5'-cscsaagaGfuAfUfUfccauuuuuau-3'(SEQ ID NO:35) and the nucleotide sequence of the antisense strand differs by no more than 2 bases from the nucleotide sequence of 5'-asUfsaaaAfauggaauAfcUfcuuggsusu-3'(SEQ ID NO:36).

In one embodiment, the nucleotide sequence of the sense strand differs by no more than 1 base form the nucleotide sequence of 5'-cscsaagaGfuAfUfUfccauuuuuau-3'(SEQ ID NO:35) and the nucleotide sequence of the antisense strand differs by no more than 1 base from the nucleotide sequence of 5'-asUfsaaaAfauggaauAfcUfcuuggsusu-3'(SEQ ID NO:36).

In one embodiment, the sense strand comprises the nucleotide sequence of 5'-cscsaagaGfuAfUfUfccauuuuuau-3'(SEQ ID NO:35) and the antisense strand comprises the nucleotide sequence of 5'-asUfsaaaAfauggaauAfcUfcuuggsusu-3'(SEQ ID NO:36).

In one embodiment, the sense strand consists of the nucleotide sequence of 5'-cscsaagaGfuAfUfUfccauuuuuau-3'(SEQ ID NO:35) and the antisense strand consists of the nucleotide sequence of 5'-asUfsaaaAfauggaauAfcUfcuuggsusu-3'(SEQ ID NO:36).

In one embodiment, the sense strand comprises the nucleotide sequence of 5'-cscsaagaGfuAfUfUfccauuuuuau-3' (SEQ ID NO:35) and the antisense strand comprises the nucleotide sequence of 5'-asUfsaaaAfauggaauAfcUfcuuggsusu-3'(SEQ ID NO:36), wherein L96 is N-[tris(GalNAc-alkyl)-amidodecanoyl)]-4-hydroxyprolinol.

In one embodiment, the dsRNA agent is conjugated to the ligand as shown in the following schematic dT is 2'-deoxythymidine-3'-phosphate; dG is 2'-deoxyguanosine-3'-phosphate; dA is 2'-deoxyadenosine-3'-phosphate; and s is a phosphorothioate linkage.

In one embodiment, the nucleotide sequence of the sense strand differs by no more than 3 bases form the nucleotide sequence of 5'-asgsagdTaUfUfCfcauuuuuacu-3'(SEQ ID NO:49) and the nucleotide sequence of the antisense strand differs by no more than 3 bases from the nucleotide sequence of 5'-asdGsuadAadAauggaaUfaCfucususg-3'(SEQ ID NO:50).

In one embodiment, the nucleotide sequence of the sense strand differs by no more than 2 bases form the nucleotide sequence of 5'-asgsagdTaUfUfCfcauuuuuacu-3' (SEQ ID NO:49) and the nucleotide sequence of the antisense strand differs by no more than 2 bases from the nucleotide sequence of 5'-asdGsuadAadAauggaaUfaCfucususg-3'(SEQ ID NO:50).

In one embodiment, the nucleotide sequence of the sense strand differs by no more than 1 base form the nucleotide sequence of 5'-asgsagdTaUfUfCfcauuuuuacu-3'(SEQ ID NO:49) and the nucleotide sequence of the antisense strand differs by no more than 1 base from the nucleotide sequence of 5'-asdGsuadAadAauggaaUfaCfucususg-3'(SEQ ID NO:50).

In one embodiment, the sense strand comprises the nucleotide sequence of 5'-asgsagdTaUfUfCfcauuuuuacu-3' (SEQ ID NO:49) and the nucleotide sequence of the antisense strand comprises the nucleotide sequence of 5'-asdGsuadAadAauggaaUfaCfucususg-3'(SEQ ID NO:50).

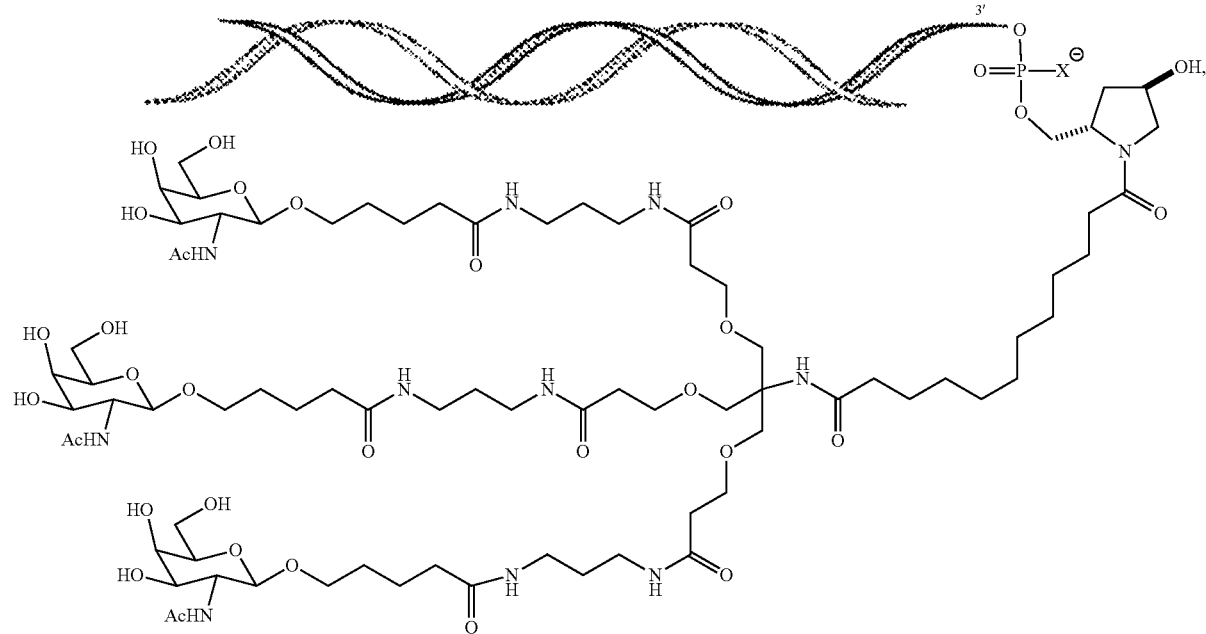

wherein X is O.

In one embodiment, the nucleotide sequence of the sense strand differs by no more than 4 bases form the nucleotide sequence of 5'-asgsagdTaUfUfCfcauuuuuacu-3' (SEQ ID NO:49) and the nucleotide sequence of the antisense strand differs by no more than 4 bases from the nucleotide sequence of 5'-asdGsuadAadAauggaaUfaCfucususg-3'(SEQ ID NO:50), wherein a, c, g, and u are 2'-O-methyl (2'-OMe) A, C, G, and U; Af, Cf, Gf and Uf are 2'-fluoro A, C, G and U;

In one embodiment, the sense strand consists of the nucleotide sequence of 5'-asgsagdTaUfUfCfcauuuuuacu-3' (SEQ ID NO:49) and the nucleotide sequence of the antisense strand consists of the nucleotide sequence of 5'-asdGsuadAadAauggaaUfaCfucususg-3'(SEQ ID NO:50).

In one embodiment, the sense strand comprises the nucleotide sequence of 5'-asgsagdTaUfUfCfcauuuuuacu-3' (SEQ ID NO:49) and the nucleotide sequence of the antisense strand comprises the nucleotide sequence of 5'-asdGsuadAadAauggaaUfaCfucususg-3'(SEQ ID NO:50), wherein L96 is N-[tris(GalNAc-alkyl)-amidodecanoyl)]-4-hydroxyprolinol.

In one embodiment, the dsRNA agent is conjugated to the ligand as shown in the following schematic

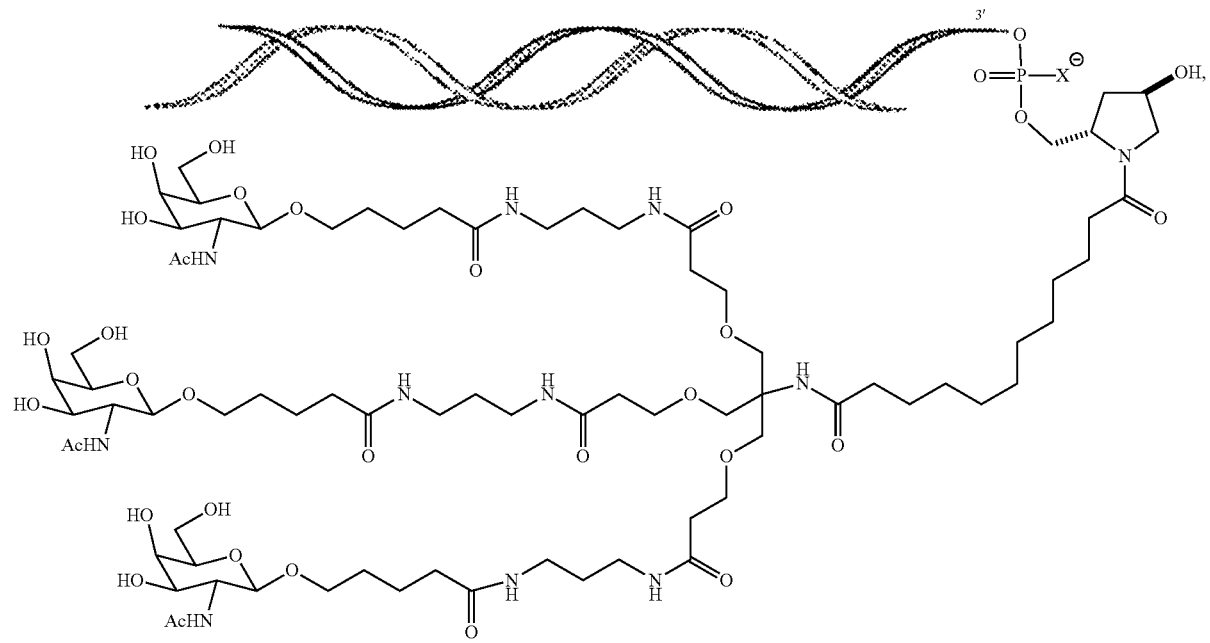

wherein X is O.

The present invention also provides cells and pharmaceutical compositions, e.g., comprising a pharmaceutically acceptable carrier, comprising the dsRNA agents of the invention.

In one embodiment, the pharmaceutical compositions of the invention comprise an unbuffered solution, e.g., saline or water.

In one embodiment, the pharmaceutical compositions of the invention comprise a buffered solution, e.g., a solution comprising acetate, citrate, prolamine, carbonate, or phosphate or any combination thereof. In one embodiment, the buffer solution is phosphate buffered saline (PBS).

In one aspect, the present invention provides a method of inhibiting expression of a transthyretin (TTR) gene in a cell. The method includes contacting the cell with a dsRNA agent of the invention, or a pharmaceutical composition of the invention, thereby inhibiting expression of the TTR gene in the cell.

In one embodiment, the cell is within a subject.

In one embodiment, the subject is a human.

In one embodiment, the subject is a subject suffering from a TTR-associated disease.

In one embodiment, the subject is a subject at risk for developing a TTR-associated disease.

In one embodiment, the subject carries a TTR gene mutation that is associated with the development of a TTR-associated disease.

In one embodiment, the TTR-associated disease is selected from the group consisting of senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease.

In one embodiment, the subject has a TTR-associated amyloidosis and said method reduces an amyloid TTR deposit in said subject.

In one embodiment, contacting the cell with the dsRNA agent inhibits the expression of TTR by at least 50%, 60%, 70%, 80%, 90%, or 95%.

In one embodiment, inhibiting expression of TTR decreases TTR protein level in serum of the subject by at least 50%, 60%, 70%, 80%, 90%, or 95%.

In another aspect, the present invention provides a method of treating a subject suffering from a TTR-associated disease or at risk for developing a TTR-associated disease. The method includes administering to the subject a therapeutically effective amount or a prophylactically effective amount of a double stranded RNAi agent of the invention, or a pharmaceutical composition of the invention, thereby treating said subject.

In one embodiment, the subject is a human.

In one embodiment, the subject is a subject suffering from a TTR-associated disease.

In one embodiment, the subject is a subject at risk for developing a TTR-associated disease.

In one embodiment, the subject carries a TTR gene mutation that is associated with the development of a TTR-associated disease.

In one embodiment, the TTR-associated disease is selected from the group consisting of senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease.

In one embodiment, the subject has a transthyretin-mediated amyloidosis (ATTR amyloidosis) and said method reduces an amyloid TTR deposit in said subject.

In one embodiment, the ATTR is hereditary ATTR (h-ATTR).

In one embodiment, the ATTR is non-hereditary ATTR (wt ATTR).

In one embodiment, administration of the dsRNA agent or pharmaceutical composition to the subject improves at least one indicia of neurological impairment, quality of life, ongoing nerve damage, or cardiovascular impairment in the subject.

In one embodiment, the double stranded RNAi agent is administered to the human subject by subcutaneous administration or intravenous administration.

In one embodiment, the subcutaneous administration is self-administration.

In one embodiment, the self-administration is via a pre-filled syringe or auto-injector syringe.

In one embodiment, the method further comprises assessing the level of TTR mRNA expression or TTR protein expression in a sample derived from the human subject.

In one aspect, the present invention provides a kit comprising a dsRNA agent of the invention or a pharmaceutical composition of the invention, and optionally, instructions for use.

In another aspect, the present invention provides a vial comprising a dsRNA agent of the invention or a pharmaceutical composition of the invention.

In one aspect, the present invention provides a syringe comprising a dsRNA agent of the invention or a pharmaceutical composition of the invention.

In one aspect, the present invention provides n RNA-induced silencing complex (RISC) comprising an antisense strand of a dsRNA agent of the invention.

DETAILED DESCRIPTION OF THE INVENTION

Figure 1:
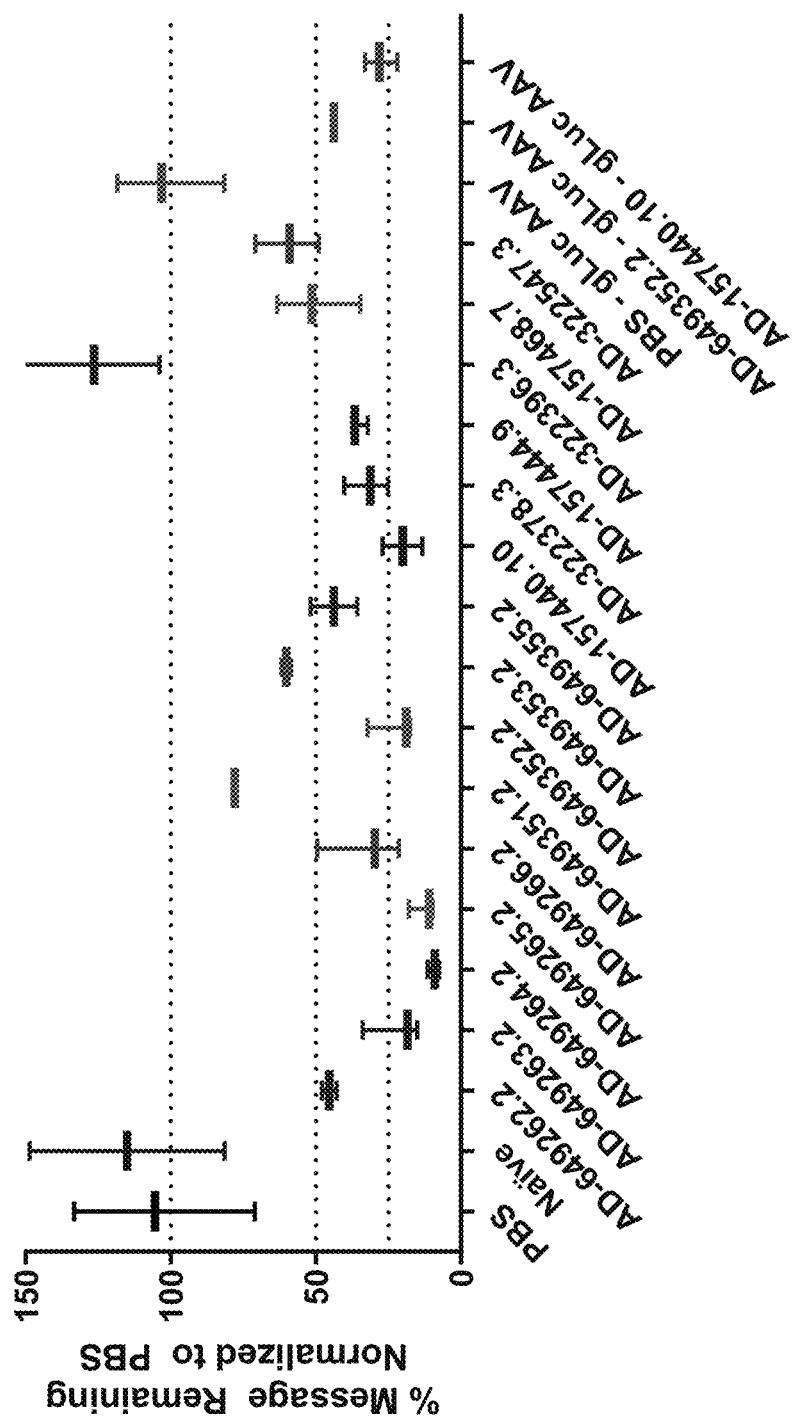
FIG. 1 is a graph showing human TTR mRNA levels in mice (n=3 per group) subcutaneously administered a single 1 mg/kg dose of the indicated dsRNA duplexes, on day 7. Human TTR mRNA levels are shown relative to control levels detected with PBS treatment.

The present invention provides iRNA compositions which effect the RNA-induced silencing complex (RISC)-mediated cleavage of RNA transcripts of a transthyretin (TTR) gene. The gene may be within a cell, e.g., a cell within a subject, such as a human. The use of these iRNAs enables the targeted degradation of mRNAs of the corresponding gene (TTR) in mammals.

The iRNAs of the invention have been designed to target the human transthyretin (TTR) gene, including portions of the gene that are conserved in the TTR orthologs of other mammalian species. Without intending to be limited by theory, it is believed that a combination of the specific target sites, the specific modifications and the attachment to a ligand in these iRNAs confer to the iRNAs of the invention improved efficacy, stability, potency, durability, and safety. Another unexpected and highly desirable feature of the iRNAs of the invention is that they exhibit no, or very low, off target activity. In the Examples presented herein the inventors have identified dsRNA agents of the invention which exhibit the least observed off-target activity of any dsRNA agent targeting any gene to date.

The present invention also provides methods for treating and preventing a transthyretin (TTR)-associated disorder, e.g., senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, or a cardiovascular disease, using iRNA compositions which effect the RNA-induced silencing complex (RISC)-mediated cleavage of RNA transcripts of an TTR gene.

The iRNAs of the invention include an RNA strand (the antisense strand) having a region which is up to about 30 nucleotides or less in length, e.g., 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of an TTR gene.

In certain embodiments, one or both of the strands of the double stranded RNAi agents of the invention is up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA transcript of an TTR gene. In some embodiments, such iRNA agents having longer length antisense strands may, for example, include a second RNA strand (the sense strand) of 20-60 nucleotides in length wherein the sense and antisense strands form a duplex of 18-30 contiguous nucleotides.

The use of iRNAs of the invention enables the targeted degradation of mRNAs of the corresponding gene (TTR gene) in mammals. Using in vitro assays, the present inventors have demonstrated that iRNAs targeting an TTR gene can potently mediate RNAi, resulting in significant inhibition of expression of an TTR gene. Thus, methods and compositions including these iRNAs are useful for treating a subject having an TTR-associated disorder, e.g., senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, or a cardiovascular disease.

Accordingly, the present invention provides methods and combination therapies for treating a subject having a disorder that would benefit from inhibiting or reducing the expression of an TTR gene, e.g., a transthyretin (TTR)-associated disorder, such as, senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease, using iRNA compositions which effect the RNA-induced silencing complex (RISC)-mediated cleavage of RNA transcripts of an TTR gene.

The present invention also provides methods for preventing at least one symptom in a subject having a disorder that would benefit from inhibiting or reducing the expression of an TTR gene, e.g., a transthyretin (TTR)-asssociated disorder, such as senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease.

The following detailed description discloses how to make and use compositions containing iRNAs to inhibit the expression of an TTR gene as well as compositions, uses, and methods for treating subjects that would benefit from inhibition and/or reduction of the expression of an TTR gene, e.g., subjects susceptible to or diagnosed with an TTR-associated disorder.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise. For example, "sense strand or antisense strand" is understood as "sense strand or antisense strand or sense strand and antisense strand."

The term "about" is used herein to mean within the typical ranges of tolerances in the art. For example, "about" can be understood as about 2 standard deviations from the mean. In certain embodiments, about means ±10%. In certain embodiments, about means ±5%. When about is present before a series of numbers or a range, it is understood that "about" can modify each of the numbers in the series or range.

The term "at least", "no less than", or "or more" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 19 nucleotides of a 21 nucleotide nucleic acid molecule" means that 19, 20, or 21 nucleotides have the indicated property. When at least is present before a series of numbers or a range, it is understood that "at least" can modify each of the numbers in the series or range.

As used herein, "no more than" or "or less" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range. As used herein, ranges include both the upper and lower limit.

As used herein, methods of detection can include determination that the amount of analyte present is below the level of detection of the method.

In the event of a conflict between an indicated target site and the nucleotide sequence for a sense or antisense strand, the indicated sequence takes precedence.

In the event of a conflict between a sequence and its indicated site on a transcript or other sequence, the nucleotide sequence recited in the specification takes precedence.

As used herein, "transthyretin" ("TTR") refers to the well-known gene and protein. TTR is also known as prealbumin, HsT2651, PALB, and TBPA. TTR functions as a transporter of retinol-binding protein (RBP), thyroxine (T4) and retinol, and it also acts as a protease. The liver secretes TTR into the blood, and the choroid plexus secretes TTR into the cerebrospinal fluid. TTR is also expressed in the pancreas and the retinal pigment epithelium. The greatest clinical relevance of TTR is that both normal (wild type) and mutant TTR protein can form amyloid fibrils that aggregate into extracellular deposits, causing amyloidosis. See, e.g., Saraiva M. J. M. (2002) *Expert Reviews in Molecular Medicine,* 4(12):1-11 for a review. The molecular cloning and nucleotide sequence of rat transthyretin, as well as the distribution of mRNA expression, was described by Dickson, P. W. et al. (1985) *J. Biol. Chem.* 260(13) 8214-8219. The X-ray crystal structure of human TTR was described in Blake, C. C. et al. (1974) *J Mol Biol* 88, 1-12.

The sequence of a human TTR mRNA transcript may be found at National Center for Biotechnology Information (NCBI) RefSeq accession number NM_000371.4 (SEQ ID NO:1; reverse complement, SEQ ID NO:5). The sequence of mouse TTR mRNA may be found at RefSeq accession number NM_013697.2 (SEQ ID NO:2; reverse complement, SEQ ID NO:6). The sequence of rat TTR mRNA may be found at RefSeq accession number NM_012681.1 (SEQ ID NO:3; reverse complement, SEQ ID NO:7). The sequence of *Macaca fascicularis* TTR mRNA may be found at RefSeq accession number NM_001283593.1 (SEQ ID NO:4; reverse complement, SEQ ID NO:8). The sequence of *Macaca mulatta* TTR mRNA may be found at RefSeq accession number NM_001261679.1 (SEQ ID NO:9; reverse complement, SEQ ID NO:10).

Additional examples of TTR mRNA sequences are readily available through publicly available databases, e.g., GenBank, UniProt, OMIM, and the *Macaca* genome project web site.

Further information on TTR can be found, for example, at www.ncbi.nlm.nih.gov/gene/?term=TTR.

The entire contents of each of the foregoing GenBank Accession numbers and the Gene database numbers are incorporated herein by reference as of the date of filing this application.

The term TTR, as used herein, also refers to variations of the TTR gene including variants provided in the SNP database. Numerous sequence variations within the TTR gene have been identified and may be found at, for example, NCBI dbSNP and UniProt (see, e.g., www.ncbi.nlm.nih.gov/snp/?term=TTR, the entire contents of which is incorporated herein by reference as of the date of filing this application.

As used herein, "target sequence" refers to a contiguous portion of the nucleotide sequence of an mRNA molecule formed during the transcription of an TTR gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of a TTR gene.

The target sequence may be from about 19-36 nucleotides in length, e.g., about 19-30 nucleotides in length. For example, the target sequence can be about 19-30 nucleotides, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In certain embodiments, the target sequence is 19-23 nucleotides in length, optionally 21-23 nucleotides in length. Ranges and lengths intermediate to the above recited ranges and lengths are also contemplated to be part of the disclosure.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of an TTR gene in a cell, e.g., a liver cell within a subject, such as a mammalian subject.

In one embodiment, an RNAi agent of the invention includes a single stranded RNA that interacts with a target RNA sequence, e.g., an TTR target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (siRNA) generated within a cell and which promotes the formation of a RISC complex to effect silencing of the target gene, i.e., an TTR gene. Accordingly, the term "siRNA" is also used herein to refer to an iRNA as described above.

In certain embodiments, the RNAi agent may be a single-stranded siRNA (ssRNAi) that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In certain embodiments, an "iRNA" for use in the compositions, uses, and methods of the invention is a double stranded RNA and is referred to herein as a "double stranded RNA agent," "double stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., an TTR gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide or a modified nucleotide. In addition, as used in this specification, an "iRNA" may include ribonucleotides with chemical modifications; an iRNA may include substantial modifications at multiple nucleotides. As used herein, the term "modified nucleotide" refers to a nucleotide having, independently, a modified sugar moiety, a modified internucleotide linkage, or modified nucleobase, or any combination thereof. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "iRNA" or "RNAi agent" for the purposes of this specification and claims.

In certain embodiments of the instant disclosure, inclusion of a deoxy-nucleotide if present within an RNAi agent can be considered to constitute a modified nucleotide.

The duplex region may be of any length that permits specific degradation of a desired target RNA through a RISC pathway, and may range from about 19 to 36 base pairs in length, e.g., about 19-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex region is 19-21 base pairs in length, e.g., 21 base pairs in length. Ranges and lengths intermediate to the above recited ranges and lengths are also contemplated to be part of the disclosure.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, 3, 4, 5, 6, 7, 8, 9, 10, 20, 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not be, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In certain embodiments, an iRNA agent of the invention is a dsRNA, each strand of which comprises 19-23 nucleotides, that interacts with a target RNA sequence, e.g., an TTR gene, to direct cleavage of the target RNA.

In some embodiments, an iRNA of the invention is a dsRNA of 24-30 nucleotides that interacts with a target RNA sequence, e.g., an TTR target mRNA sequence, to direct the cleavage of the target RNA.

As used herein, the term "nucleotide overhang" refers to at least one unpaired nucleotide that protrudes from the duplex structure of a double stranded iRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotides, e.g., a 1, 2, 3, 4, 5, 6, 7, 8, 9, or 10 nucleotide, overhang at the 3'-end or the 5'-end. In certain embodiments, the overhang on the sense strand or the antisense strand, or both, can include extended lengths longer than nucleotides, e.g., 1-30 nucleotides, 2-30 nucleotides, 10-30 nucleotides, 10-25 nucleotides, 10-20 nucleotides, or 10-15 nucleotides in length. In certain embodiments, an extended overhang is on the sense strand of the duplex. In certain embodiments, an extended overhang is present on the 3' end of the sense strand of the duplex. In certain embodiments, an extended overhang is present on the 5' end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the extended overhang is replaced with a nucleoside thiophosphate. In certain embodiments, the overhang includes a self-complementary portion such that the overhang is capable of forming a hairpin structure that is stable under physiological conditions.

"Blunt" or "blunt end" means that there are no unpaired nucleotides at that end of the double stranded RNA agent, i.e., no nucleotide overhang. A "blunt ended" double stranded RNA agent is double stranded over its entire length, i.e., no nucleotide overhang at either end of the molecule. The RNAi agents of the invention include RNAi agents with no nucleotide overhang at one end (i.e., agents with one overhang and one blunt end) or with no nucleotide overhangs at either end. Most often such a molecule will be double-stranded over its entire length.

The term "antisense strand" or "guide strand" refers to the strand of an iRNA, e.g., a dsRNA, which includes a region that is substantially complementary to a target sequence, e.g., an TTR mRNA.

As used herein, the term "region of complementarity" refers to the region on the antisense strand that is substantially complementary to a sequence, for example a target sequence, e.g., an TTR nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, or 3 nucleotides of the 5'- or 3'-end of the iRNA. In some embodiments, a double stranded RNA agent of the invention includes a nucleotide mismatch in the antisense strand. In some embodiments, the antisense strand of the double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand of the double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA agent. In some embodiments, the mismatch(es) is not in the seed region.

Thus, an RNAi agent as described herein can contain one or more mismatches to the target sequence. In one embodiment, an RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of an TTR gene, generally does not contain any mismatch within the central 13 nucleotides. The methods described herein or methods known in the art can be used to determine whether an RNAi agent containing a mismatch to a target sequence is effective in inhibiting the expression of an TTR gene. Consideration of the efficacy of RNAi agents with mismatches in inhibiting expression of an TTR gene is important, especially if the particular region of complementarity in an TTR gene is known to have polymorphic sequence variation within the population.

The term "sense strand" or "passenger strand" as used herein, refers to the strand of an iRNA that includes a region that is substantially complementary to a region of the antisense strand as that term is defined herein.

As used herein, "substantially all of the nucleotides are modified" are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression, in vitro or in vivo. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogsteen base pairing.

The terms "complementary," "fully complementary" and "substantially complementary" herein can be used with respect to the base matching between the sense strand and the antisense strand of a dsRNA, or between two oligonucleotides or polynucleotides, such as the antisense strand of a double stranded RNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding an TTR gene). For example, a polynucleotide is complementary to at least a part of an TTR mRNA if the sequence is substantially complementary to a non-interrupted portion of an mRNA encoding an TTR gene.

Accordingly, in some embodiments, the antisense polynucleotides disclosed herein are fully complementary to the target TTR sequence. In other embodiments, the antisense polynucleotides disclosed herein are substantially complementary to the target TTR sequence and comprise a contiguous nucleotide sequence which is at least 80% complementary over its entire length to the equivalent region of the nucleotide sequence of any one of SEQ ID NOs:1, 3, 5, 7, or 9, or a fragment of any one of SEQ ID NOs:1, 3, 5, 7, or 9, such as about 85%, about 90%, about 91%, about 92%, about 93%, about 94%, about 95%, about 96%, about 97%, about 98%, or about 99% complementary.

In other embodiments, the antisense polynucleotides disclosed herein are substantially complementary to the target TTR sequence and comprise a contiguous nucleotide sequence which is at least about 80% complementary over its entire length to any one of the sense strand nucleotide sequences in any one of any one of Tables 2, 3, 5, and 6, or a fragment of any one of the sense strand nucleotide sequences in any one of Tables 2, 3, 5, and 6, such as about 85%, about 90%, about 91%, about 92%, about 93%, about 94%, about 95%, about 96%, about 97%, about 98%, about 99%, or 100% complementary.

In one embodiment, an RNAi agent of the disclosure includes a sense strand that is substantially complementary to an antisense polynucleotide which, in turn, is the same as a target TTR sequence, and wherein the sense strand polynucleotide comprises a contiguous nucleotide sequence which is at least about 80% complementary over its entire length to the equivalent region of the nucleotide sequence of SEQ ID NOs: 2, 4, 6, 8, or 10, or a fragment of any one of SEQ ID NOs:2, 4, 6, 8, or 10, such as about 85%, about 90%, about 91%, about 92%, about 93%, about 94%, about 95%, about 96%, about 97%, about 98%, about 99%, or 100% complementary.

In some embodiments, an iRNA of the invention includes a sense strand that is substantially complementary to an antisense polynucleotide which, in turn, is complementary to a target TTR sequence, and wherein the sense strand polynucleotide comprises a contiguous nucleotide sequence which is at least about 80% complementary over its entire length to any one of the antisense strand nucleotide sequences in any one of any one of Tables 2, 3, 5, and 6, or a fragment of any one of the antisense strand nucleotide sequences in any one of Tables 2, 3, 5, and 6, such as about 85%, about 90%, about 91%, about 92%, about 93%, about 94%, about 95%, about 96%, about 97%, about 98%, about 99%, or 100% complementary.

In general, an "iRNA" includes ribonucleotides with chemical modifications. Such modifications may include all types of modifications disclosed herein or known in the art. Any such modifications, as used in a dsRNA molecule, are encompassed by "iRNA" for the purposes of this specification and claims.

In certain embodiments of the instant disclosure, inclusion of a deoxy-nucleotide if present within an RNAi agent can be considered to constitute a modified nucleotide.

In an aspect of the invention, an agent for use in the methods and compositions of the invention is a single-stranded antisense oligonucleotide molecule that inhibits a target mRNA via an antisense inhibition mechanism. The single-stranded antisense oligonucleotide molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense oligonucleotide molecule may be about 14 to about 30 nucleotides in length and have a sequence that is complementary to a target sequence. For example, the single-stranded antisense oligonucleotide molecule may comprise a sequence that is at least about 14, 15, 16, 17, 18, 19, 20, or more contiguous nucleotides from any one of the antisense sequences described herein.

The phrase "contacting a cell with an iRNA," such as a dsRNA, as used herein, includes contacting a cell by any possible means. Contacting a cell with an iRNA includes contacting a cell in vitro with the iRNA or contacting a cell in vivo with the iRNA. The contacting may be done directly or indirectly. Thus, for example, the iRNA may be put into physical contact with the cell by the individual performing the method, or alternatively, the iRNA may be put into a situation that will permit or cause it to subsequently come into contact with the cell.

Contacting a cell in vitro may be done, for example, by incubating the cell with the iRNA. Contacting a cell in vivo may be done, for example, by injecting the iRNA into or near the tissue where the cell is located, or by injecting the iRNA into another area, e.g., the bloodstream or the subcutaneous space, such that the agent will subsequently reach the tissue where the cell to be contacted is located. For example, the iRNA may contain or be coupled to a ligand, e.g., GalNAc, that directs the iRNA to a site of interest, e.g., the liver. Combinations of in vitro and in vivo methods of contacting are also possible. For example, a cell may also be contacted in vitro with an iRNA and subsequently transplanted into a subject.

In certain embodiments, contacting a cell with an iRNA includes "introducing" or "delivering the iRNA into the cell" by facilitating or effecting uptake or absorption into the cell. Absorption or uptake of an iRNA can occur through unaided diffusion or active cellular processes, or by auxiliary agents or devices. Introducing an iRNA into a cell may be in vitro or in vivo. For example, for in vivo introduction, iRNA can be injected into a tissue site or administered systemically. In vitro introduction into a cell includes methods known in the art such as electroporation and lipofection. Further approaches are described herein below or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a horse, a goat, a rabbit, a sheep, a hamster, a guinea pig, a cat, a dog, a rat, or a mouse), or a bird that expresses the target gene, either endogenously or heterologously.

In one embodiment, the subject is a human, such as a human being treated or assessed for a disease or disorder that would benefit from reduction in TTR expression; a human at risk for a disease or disorder that would benefit from reduction in TTR expression; a human having a disease or disorder that would benefit from reduction in TTR expression; or human being treated for a disease or disorder that would benefit from reduction in TTR expression as described herein. In some embodiments, the subject is a female human. In other embodiments, the subject is a male human. In one embodiment, the subject is an adult subject. In another embodiment, the subject is a pediatric subject.

In some embodiments, the human subject is suffering from a TTR-associated disease. In other embodiments, the subject is a subject at risk for developing a TTR-associated disease, e.g., a subject with a TTR gene mutation that is associated with the development of a TTR associated disease, a subject with a family history of TTR-associated disease, or a subject who has signs or symptoms suggesting the development of TTR associated disease without meeting the diagnostic criteria for a TTR-associated disease.

As used herein, the terms "treating" or "treatment" refer to a beneficial or desired result, such as reducing at least one sign or symptom of an TTR-associated disorder in a subject. Treatment also includes a reduction of one or more sign or symptoms associated with unwanted TTR expression; diminishing the extent of unwanted TTR activation or stabilization; amelioration or palliation of unwanted TTR activation or stabilization. "Treatment" can also mean prolonging survival as compared to expected survival in the absence of treatment.

The term "lower" in the context of the level of TTR in a subject or a disease marker or symptom refers to a statistically significant decrease in such level. The decrease can be, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., protein or gene expression level. "Lower" in the context of the level of TTR in a subject is a decrease to a level accepted as within the range of normal for an individual without such disorder. In certain embodiments, "lower" is the decrease in the difference between the level of a marker or symptom for a subject suffering from a disease and a level accepted within the range of normal for an individual. The term "lower" can also be used in association with normalizing a symptom of a disease or condition, i.e. decreasing the difference between a level in a subject suffering from an TTR-associated disorder towards or to a level in a normal subject not suffering from an TTR-associated disorder. As used herein, if a disease is associated with an elevated value for a symptom, "normal" is considered to be the upper limit of normal. If a disease is associated with a decreased value for a symptom, "normal" is considered to be the lower limit of normal.

As used herein, "prevention" or "preventing," when used in reference to a disease, disorder or condition thereof, may be treated or ameliorated by a reduction in expression of an TTR gene, refers to a reduction in the likelihood that a subject will develop a symptom associated with such a disease, disorder, or condition, e.g., a symptom of an TTR-associated disorder, e.g., senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, and hyperthyroxinemia. The failure to develop a disease, disorder or condition, or the reduction in the development of a symptom associated with such a disease, disorder or condition (e.g., by at least about 10% on a clinically accepted scale for that disease or disorder), or the exhibition of delayed symptoms delayed (e.g., by days, weeks, months or years) is considered effective prevention.

A "TTR-associated disease," as used herein, is intended to include any disease associated with the TTR gene or protein. Such a disease may be caused, for example, by excess production of the TTR protein, by TTR gene mutations, by abnormal cleavage of the TTR protein, instability of TTR tetramers, by abnormal interactions between TTR and other proteins or other endogenous or exogenous substances. A "TTR-associated disease" includes any type of transthyretin-mediated amyloidosis (ATTR amyloidosis) wherein TTR plays a role in the formation of abnormal extracellular aggregates or amyloid deposits, e.g., either hereditary ATTR (h-ATTR) amyloidosis or non-hereditary ATTR (ATTR) amyloidosis. TTR-associated diseases include senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, amyloidotic vitreous opacities, carpal tunnel syndrome, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease. Symptoms of TTR amyloidosis include sensory neuropathy (e.g., paresthesia, hypesthesia in distal limbs), autonomic neuropathy (e.g., gastrointestinal dysfunction, such as gastric ulcer, or orthostatic hypotension), motor neuropathy, seizures, dementia, myelopathy, polyneuropathy, carpal tunnel syndrome, autonomic insufficiency, cardiomyopathy, vitreous opacities, renal insufficiency, nephropathy, substantially reduced mBMI (modified Body Mass Index), cranial nerve dysfunction, and corneal lattice dystrophy.

"Therapeutically effective amount," as used herein, is intended to include the amount of an RNAi agent that, when administered to a subject having an TTR-associated disorder, is sufficient to effect treatment of the disease (e.g., by diminishing, ameliorating, or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an RNAi agent that, when administered to a subject having an TTR-associated disorder, is sufficient to prevent or ameliorate the disorder or one or more symptoms of the disorder. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired effect at a reasonable benefit/risk ratio applicable to any treatment. The iRNA employed in the methods of the present invention may be administered in a sufficient amount to produce a reasonable benefit/risk ratio applicable to such treatment.

The phrase "pharmaceutically acceptable" is employed herein to refer to those compounds, materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition, or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Such carriers are known in the art. Pharmaceutically acceptable carriers include carriers for administration by injection.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs, or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to urine obtained from the subject. A "sample derived from a subject" can refer to blood or blood derived serum or plasma from the subject.

II. iRNAs of the Invention

The present invention provides iRNAs which inhibit the expression of an TTR gene. In certain embodiments, the iRNA includes double stranded ribonucleic acid (dsRNA) molecules for inhibiting the expression of an TTR gene in a cell, such as a cell within a subject, e.g., a mammal, such as a human susceptible to developing an TTR-associated disorder, e.g., senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, and hyperthyroxinemia. The dsRNAi agent includes an antisense strand having a region of complementarity which is complementary to at least a part of an mRNA formed in the expression of an TTR gene. The region of complementarity is about 19-30 nucleotides in length (e.g., about 30, 29, 28, 27, 26, 25, 24, 23, 22, 21, 20, or 19 nucleotides in length).

Upon contact with a cell expressing the TTR gene, the iRNA inhibits the expression of the TTR gene (e.g., a human, a primate, a non-primate, or a rat TTR gene) by at least about 50% as assayed by, for example, a PCR or branched DNA (bDNA)-based method, or by a protein-based method, such as by immunofluorescence analysis, using, for example, western blotting or flow cytometric techniques. In certain embodiments, inhibition of expression is determined by the qPCR method provided in the examples herein with the siRNA at, e.g., a 10 nM concentration, in an appropriate organism cell line provided therein. In certain embodiments, inhibition of expression in vivo is determined by knockdown of the human gene in a rodent expressing the human gene, e.g., a mouse or an AAV-infected mouse expressing the human target gene, e.g., when administered as single dose, e.g., at 3 mg/kg at the nadir of RNA expression.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an TTR gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure.

Similarly, the region of complementarity to the target sequence is 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, for example 19-23 nucleotides in length or 21-23 nucleotides in length. Ranges and lengths intermediate to the above recited ranges and lengths are also contemplated to be part of the disclosure.

In some embodiments, the duplex structure is 19 to 30 base pairs in length. Similarly, the region of complementarity to the target sequence is 19 to 30 nucleotides in length.

In some embodiments, the dsRNA is about 19 to about 23 nucleotides in length, or about 25 to about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 19 to about 30 base pairs, e.g., about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target TTR gene expression is not generated in the target cell by cleavage of a larger dsRNA.

A dsRNA as described herein can further include one or more single-stranded nucleotide overhangs, e.g., 1-4, 2-4, 1-3, 2-3, 1, 2, 3, or 4 nucleotides. dsRNAs having at least one nucleotide overhang can have superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of an antisense or sense strand of a dsRNA.

A dsRNA can be synthesized by standard methods known in the art. Double stranded RNAi compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Similarly, single-stranded oligonucleotides of the invention can be prepared using solution-phase or solid-phase organic synthesis or both.

In an aspect, a dsRNA of the invention includes at least two nucleotide sequences, a sense sequence and an antisense sequence. The sense strand is selected from the group of sequences provided in any one of Tables 2, 3, 5, and 6, and the corresponding antisense strand of the sense strand is selected from the group of sequences of any one of Tables 2, 3, 5, and 6. In this aspect, one of the two sequences is complementary to the other of the two sequences, with one of the sequences being substantially complementary to a sequence of an mRNA generated in the expression of an TTR gene. As such, in this aspect, a dsRNA will include two oligonucleotides, where one oligonucleotide is described as the sense strand in any one of Tables 2, 3, 5, and 6, and the second oligonucleotide is described as the corresponding antisense strand of the sense strand in any one of Tables 2, 3, 5, and 6.

In certain embodiments, the substantially complementary sequences of the dsRNA are contained on separate oligonucleotides. In other embodiments, the substantially complementary sequences of the dsRNA are contained on a single oligonucleotide.

It will be understood that, although the sequences in, for example, Table 2, are not described as modified or conjugated sequences, the RNA of the iRNA of the invention e.g., a dsRNA of the invention, may comprise any one of the sequences set forth in any one of Tables 2, 3, 5, and 6 that is un-modified, un-conjugated, or modified or conjugated differently than described therein. In other words, the invention encompasses dsRNA of Tables 2, 3, 5, and 6 which are un-modified, un-conjugated, modified, or conjugated, as described herein.

The skilled person is well aware that dsRNAs having a duplex structure of about 20 to 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) RNA 14:1714-1719; Kim et al. (2005) *Nat Biotech* 23:222-226). In the embodiments described above, by virtue of the nature of the oligonucleotide sequences provided in any one of Tables 2, 3, 5, and 6, dsRNAs described herein can include at least one strand of a length of minimally 21 nucleotides. It can be reasonably expected that shorter duplexes having any one of the sequences in any one of Tables 2, 3, 5, and 6 minus only a few nucleotides on one or both ends can be similarly effective as compared to the dsRNAs described above. Hence, dsRNAs having a sequence of at least 19, 20, or more contiguous nucleotides derived from any one of the sequences of any one of Tables 2, 3, 5, and 6, and differing in their ability to inhibit the expression of an TTR gene by not more than about 5, 10, 15, 20, 25, or 30% inhibition from a dsRNA comprising the full sequence, are contemplated to be within the scope of the present invention.

In addition, the RNAs provided in Tables 2, 3, 5, and 6 identify a site(s) in an TTR transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 19 contiguous nucleotides from any one of the sequences provided in any one of Tables 2, 3, 5, and 6 coupled to additional nucleotide sequences taken from the region contiguous to the selected sequence in an TTR gene.

III. Modified iRNAs of the Invention

In certain embodiments, the RNA of the iRNA of the invention e.g., a dsRNA, is un-modified, and does not comprise, e.g., chemical modifications or conjugations known in the art and described herein. In other embodiments, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA or substantially all of the nucleotides of an iRNA are modified, i.e., not more than 5, 4, 3, 2, or 1 unmodified nucleotides are present in a strand of the iRNA.

The nucleic acids featured in the invention can be synthesized or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester and/or phosphorothioate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothioate groups present in the agent.

Representative U.S. Patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

Representative U.S. Patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, the entire contents of each of which are hereby incorporated herein by reference.

Suitable RNA mimetics are contemplated for use in iRNAs provided herein, in which both the sugar and the internucleoside linkage, i.e., the backbone, of the nucleotide units are replaced with novel groups. The base units are maintained for hybridization with an appropriate nucleic acid target compound. One such oligomeric compound in which an RNA mimetic that has been shown to have excellent hybridization properties is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative US patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., Science, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$—[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506. The native phosphodiester backbone can be represented as O—P(O)(OH)—OCH2-.

Modified RNAs can also contain one or more substituted sugar moieties. The iRNAs, e.g., dsRNAs, featured herein can include one of the following at the 2'-position: OH; F; O—, S—, or N-alkyl; O—, S—, or N-alkenyl; O—, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_n$OCH$_3$, O($CH_2$)$_n$NH$_2$, O($CH_2$)$_n$CH$_3$, O($CH_2$)$_n$ONH$_2$, and O($CH_2$)$_n$ON[($CH_2$)$_n$CH)]$_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chico. Acta,* 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—$N(CH_3)_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative US patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C), and uracil (U). Modified nucleobases include other synthetic and natural nucleobases such as deoxythymidine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. Patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

In some embodiments, an RNAi agent of the disclosure can also be modified to include one or more bicyclic sugar moieties. A "bicyclic sugar" is a furanosyl ring modified by a ring formed by the bridging of two carbons, whether adjacent or non-adjacent. A "bicyclic nucleoside" ("BNA") is a nucleoside having a sugar moiety comprising a ring formed by bridging two carbons, whether adjacent or non-adjacent, of the sugar ring, thereby forming a bicyclic ring system. In certain embodiments, the bridge connects the 4'-carbon and the 2'-carbon of the sugar ring, optionally, via the 2'-acyclic oxygen atom. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-$CH_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge.

A locked nucleoside can be represented by the structure (omitting stereochemistry),

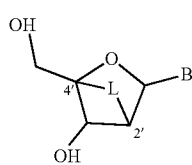

wherein B is a nucleobase or modified nucleobase and L is the linking group that joins the 2'-carbon to the 4'-carbon of the ribose ring. Examples of such 4' to 2' bridged bicyclic nucleosides, include but are not limited to 4'-(CH$_2$)—O-2' (LNA); 4'-(CH$_2$)—S-2'; 4'-(CH$_2$)$_2$—O-2' (ENA); 4'-CH(CH$_3$)—O-2' (also referred to as "constrained ethyl" or "cEt") and 4'-CH(CH$_2$OCH$_3$)—O-2' (and analogs thereof; see, e.g., U.S. Pat. No. 7,399,845); 4'-C(CH$_3$)(CH$_3$)—O-2' (and analogs thereof; see e.g., U.S. Pat. No. 8,278,283); 4'-CH$_2$—N(OCH$_3$)-2' (and analogs thereof; see e.g., U.S. Pat. No. 8,278,425); 4'-CH$_2$—O—N(CH$_3$)-2' (see, e.g., U.S. Patent Publication No. 2004/0171570); 4'-CH$_2$—N(R)—O-2', wherein R is H, C1-C12 alkyl, or a nitrogen protecting group (see, e.g., U.S. Pat. No. 7,427,672); 4'-CH$_2$—C(H)(CH 3)-2' (see, e.g., Chattopadhyaya et al., *J. Org. Chem.*, 2009, 74, 118-134); and 4'-CH$_2$—C(=CH$_2$)-2' (and analogs thereof; see, e.g., U.S. Pat. No. 8,278,426). The entire contents of each of the foregoing are hereby incorporated herein by reference.

Additional representative U.S. Patents and U.S. Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH(CH$_3$)—O-2' bridge (i.e., L in the preceding structure). In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2'and C4' carbons of ribose or the C3 and -C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, U.S. Patent Publication No. 2013/0190383; and PCT publication WO 2013/036868, the entire contents of each of which are hereby incorporated herein by reference.

In some embodiments, an iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

Representative U.S. publications that teach the preparation of UNA include, but are not limited to, U.S. Pat. No. 8,314,227; and U.S. Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of the nucleotides of an iRNA of the invention include a 5' phosphate or 5' phosphate mimic, e.g., a 5'-terminal phosphate or phosphate mimic on the antisense strand of an iRNA. Suitable phosphate mimics are disclosed in, for example U.S. Patent Publication No. 2012/0157511, the entire contents of which are incorporated herein by reference.

A. Modified iRNAs Comprising Motifs of the Invention

In certain aspects of the invention, the double stranded RNA agents of the invention include agents with chemical modifications as disclosed, for example, in WO2013/075035, the entire contents of each of which are incorporated herein by reference. As shown herein and in WO2013/075035, one or more motifs of three identical modifications on three consecutive nucleotides may be introduced into a sense strand or antisense strand of a dsRNAi agent, particularly at or near the cleavage site. In some embodiments, the sense strand and antisense strand of the dsRNAi agent may otherwise be completely modified. The introduction of these motifs interrupts the modification pattern, if present, of the sense or antisense strand. The dsRNAi agent may be optionally conjugated with a GalNAc derivative ligand, for instance on the sense strand.

More specifically, when the sense strand and antisense strand of the double stranded RNA agent are completely modified to have one or more motifs of three identical modifications on three consecutive nucleotides at or near the cleavage site of at least one strand of a dsRNAi agent, the gene silencing activity of the dsRNAi agent was observed.

Accordingly, the invention provides double stranded RNA agents capable of inhibiting the expression of a target gene (i.e., TTR gene) in vivo. The RNAi agent comprises a sense strand and an antisense strand. Each strand of the RNAi agent may be, for example, 17-30 nucleotides in length, 25-30 nucleotides in length, 27-30 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as "dsRNAi agent." The duplex region of a dsRNAi agent may be, for example, the duplex region can be 27-30 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 19, 20, 21, 22, 23, 24, 25, 26, and 27 nucleotides in length.

In certain embodiments, the dsRNAi agent may contain one or more overhang regions or capping groups at the 3'-end, 5'-end, or both ends of one or both strands. The overhang can be, independently, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In certain embodiments, the overhang regions can include extended overhang regions as provided above. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In certain embodiments, the nucleotides in the overhang region of the dsRNAi agent can each independently be a modified or unmodified nucleotide including, but no limited to 2'-sugar modified, such as, 2'-F, 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand, or both strands of the dsRNAi agent may be phosphorylated. In some embodiments, the overhang region(s) contains two nucleotides having a phosphorothioate between the two nucleotides, where the two nucleotides can be the same or different. In some embodiments, the overhang is present at the 3'-end of the sense strand, antisense strand, or both strands. In some embodiments, this 3'-overhang is present in the antisense strand. In some embodiments, this 3'-overhang is present in the sense strand.

The dsRNAi agent may contain only a single overhang, which can strengthen the interference activity of the RNAi, without affecting its overall stability. For example, the single-stranded overhang may be located at the 3'-end of the sense strand or, alternatively, at the 3'-end of the antisense strand. The RNAi may also have a blunt end, located at the 5'-end of the antisense strand (i.e., the 3'-end of the sense strand) or vice versa. Generally, the antisense strand of the dsRNAi agent has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In certain embodiments, the dsRNAi agent is a double blunt-ended of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, and 13 from the 5'end.

In other embodiments, the dsRNAi agent is a double blunt-ended of 20 nucleotides in length, wherein the sense strand contains at least one motif of three 2'-F modifications on three consecutive nucleotides at positions 8, 9, and 10 from the 5'end. The antisense strand contains at least one motif of three 2'-O-methyl modifications on three consecutive nucleotides at positions 11, 12, and 13 from the 5'end.

In yet other embodiments, the dsRNAi agent is a double blunt-ended of 21 nucleotides in length, wherein the sense strand contains at least one motif of three 2'-F modifications on three consecutive nucleotides at positions 9, 10, and 11 from the 5'end. The antisense strand contains at least one motif of three 2'-O-methyl modifications on three consecutive nucleotides at positions 11, 12, and 13 from the 5'end.

In certain embodiments, the dsRNAi agent comprises a 21 nucleotide sense strand and a 23 nucleotide antisense strand, wherein the sense strand contains at least one motif of three 2'-F modifications on three consecutive nucleotides at positions 9, 10, and 11 from the 5'end; the antisense strand contains at least one motif of three 2'-O-methyl modifications on three consecutive nucleotides at positions 11, 12, and 13 from the 5'end, wherein one end of the RNAi agent is blunt, while the other end comprises a 2 nucleotide overhang. In one embodiment, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In certain embodiments, every nucleotide in the sense strand and the antisense strand of the dsRNAi agent, including the nucleotides that are part of the motifs are modified nucleotides. In certain embodiments each residue is independently modified with a 2'-O-methyl or 3'-fluoro, e.g., in an alternating motif. Optionally, the dsRNAi agent further comprises a ligand (such as, GalNAc$_3$).

In certain embodiments, the dsRNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3 ' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In certain embodiments, the dsRNAi agent comprises sense and antisense strands, wherein the dsRNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1~4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein Dicer cleavage of the dsRNAi agent results in an siRNA comprising the 3'-end of the second strand, thereby reducing expression of the target gene in the mammal. Optionally, the dsRNAi agent further comprises a ligand.

In certain embodiments, the sense strand of the dsRNAi agent contains at least one motif of three identical modifications on three consecutive nucleotides, where one of the motifs occurs at the cleavage site in the sense strand.

In certain embodiments, the antisense strand of the dsRNAi agent can also contain at least one motif of three identical modifications on three consecutive nucleotides, where one of the motifs occurs at or near the cleavage site in the antisense strand.

For a dsRNAi agent having a duplex region of 19-23 nucleotides in length, the cleavage site of the antisense strand is typically around the 10, 11, and 12 positions from the 5'-end. Thus the motifs of three identical modifications may occur at the 9, 10, 11 positions; the 10, 11, 12 positions; the 11, 12, 13 positions; the 12, 13, 14 positions; or the 13, 14, 15 positions of the antisense strand, the count starting from the first nucleotide from the 5'-end of the antisense strand, or, the count starting from the first paired nucleotide within the duplex region from the 5'-end of the antisense strand. The cleavage site in the antisense strand may also change according to the length of the duplex region of the dsRNAi agent from the 5'-end.

The sense strand of the dsRNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In some embodiments, the sense strand of the dsRNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistries of the motifs are distinct from each other, and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the dsRNAi agent may contain more than one motif of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In some embodiments, the wing modification on the sense strand or antisense strand of the dsRNAi agent typically does not include the first one or two terminal nucleotides at the 3'-end, 5'-end, or both ends of the strand.

In other embodiments, the wing modification on the sense strand or antisense strand of the dsRNAi agent typically does not include the first one or two paired nucleotides within the duplex region at the 3'-end, 5'-end, or both ends of the strand.

When the sense strand and the antisense strand of the dsRNAi agent each contain at least one wing modification, the wing modifications may fall on the same end of the duplex region, and have an overlap of one, two, or three nucleotides.

When the sense strand and the antisense strand of the dsRNAi agent each contain at least two wing modifications, the sense strand and the antisense strand can be so aligned that two modifications each from one strand fall on one end of the duplex region, having an overlap of one, two, or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In some embodiments, every nucleotide in the sense strand and antisense strand of the dsRNAi agent, including the nucleotides that are part of the motifs, may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2'-hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3'- or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or nucleotides of a strand, or may occur in double strand and single strand regions, particularly at termini. The 5'-end or ends can be phosphorylated.

It may be possible, e.g., to enhance stability, to include particular bases in overhangs, or to include modified nucleotides or nucleotide surrogates, in single strand overhangs, e.g., in a 5'- or 3'-overhang, or in both. For example, it can be desirable to include purine nucleotides in overhangs. In some embodiments all or some of the bases in a 3'- or 5'-overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, CRN, cET, UNA, HNA, CeNA, 2'-methoxyethyl, 2'-O-methyl, 2'-O-allyl, 2'-C- allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In certain embodiments, the $N_a$ or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AAB-BAABBAABB . . . ," "AABAABAABAAB . . . ," "AAA-BAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABA-BAB . . . ", "ACACAC . . . " "BDBDBD . . . " or "CDC-DCD . . . ," etc.

In some embodiments, the dsRNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5' to 3' of the strand and the alternating motif in the antisense strand may start with "BABABA" from 5' to 3' of the strand within the duplex region. As another example, the alternating motif in the sense strand may start with "AABBAABB" from 5' to 3' of the strand and the alternating motif in the antisense strand may start with "BBAABBAA" from 5' to 3' of the strand within the duplex region, so that there is a complete or partial shift of the modification patterns between the sense strand and the antisense strand.

In some embodiments, the dsRNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand or antisense strand interrupts the initial modification pattern present in the sense strand or antisense strand. This interruption of the modification pattern of the sense or antisense strand by introducing one or more motifs of three identical modifications on three consecutive nucleotides to the sense or antisense strand may enhance the gene silencing activity against the target gene.

In some embodiments, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ or $N_b$ may be present or absent when there is a wing modification present.

The iRNA may further comprise at least one phosphorothioate or methylphosphonate internucleotide linkage. The phosphorothioate or methylphosphonate internucleotide linkage modification may occur on any nucleotide of the sense strand, antisense strand, or both strands in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8 phosphorothioate internucleotide linkages. In some embodiments, the antisense strand comprises two phosphorothioate internucleotide linkages at the 5'-end and two phosphorothioate internucleotide linkages at the 3'-end, and the sense strand comprises at least two phosphorothioate internucleotide linkages at either the 5'-end or the 3'-end.

In some embodiments, the dsRNAi agent comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, or the 5'end of the antisense strand.

In some embodiments, the 2-nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the dsRNAi agent may additionally have two phosphorothioate internucleotide linkages between the terminal three nucleotides at both the 5'-end of the sense strand and at the 5'-end of the antisense strand.

In one embodiment, the dsRNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In certain embodiments, the dsRNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In certain embodiments, the nucleotide at the 1 position within the duplex region from the 5'-end in the antisense strand is selected from A, dA, dU, U, and dT. Alternatively, at least one of the first 1, 2, or 3 base pair within the duplex region from the 5'-end of the antisense strand is an AU base pair. For example, the first base pair within the duplex region from the 5'-end of the antisense strand is an AU base pair.

In other embodiments, the nucleotide at the 3'-end of the sense strand is deoxythymidine (dT) or the nucleotide at the 3'-end of the antisense strand is deoxythymidine (dT). For example, there is a short sequence of deoxythymidine nucleotides, for example, two dT nucleotides on the 3'-end of the sense, antisense strand, or both strands.

In certain embodiments, the sense strand sequence may be represented by formula (I):

5'n$_p$-N$_a$-(X X X)$_i$-N$_b$-Y Y Y-N$_b$-(Z Z Z)$_j$-N$_a$-n$_q$3'   (I)

wherein:
i and j are each independently 0 or 1;
p and q are each independently 0-6;
each N$_a$ independently represents an oligonucleotide sequence comprising 0-25 modified nucleotides, each sequence comprising at least two differently modified nucleotides;
each N$_b$ independently represents an oligonucleotide sequence comprising 0-10 modified nucleotides;

each n$_p$ and n$_q$ independently represent an overhang nucleotide;
wherein N$_b$ and Y do not have the same modification; and
XXX, YYY, and ZZZ each independently represent one motif of three identical modifications on three consecutive nucleotides. In one embodiment, YYY is all 2'-F modified nucleotides.

In some embodiments, the N$_a$ or N$_b$ comprises modifications of alternating pattern.

In some embodiments, the YYY motif occurs at or near the cleavage site of the sense strand. For example, when the dsRNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11, 12; or 11, 12, 13) of the sense strand, the count starting from the first nucleotide, from the 5'-end; or optionally, the count starting at the first paired nucleotide within the duplex region, from the 5'-end.

In one embodiment, i is 1 and j is 0, or i is 0 and j is 1, or both i and j are 1. The sense strand can therefore be represented by the following formulas:

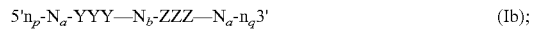   (Ib);

   (Ic); or

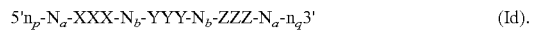   (Id).

When the sense strand is represented by formula (Ib), N$_b$ represents an oligonucleotide sequence comprising 0-10, 0-7, 0-5, 0-4, 0-2, or 0 modified nucleotides. Each N$_a$ independently can represent an oligonucleotide sequence comprising 2-20, 2-15, or 2-10 modified nucleotides.

When the sense strand is represented as formula (Ic), N$_b$ represents an oligonucleotide sequence comprising 0-10, 0-7, 0-10, 0-7, 0-5, 0-4, 0-2, or 0 modified nucleotides. Each N$_a$ can independently represent an oligonucleotide sequence comprising 2-20, 2-15, or 2-10 modified nucleotides.

When the sense strand is represented as formula (Id), each N$_b$ independently represents an oligonucleotide sequence comprising 0-10, 0-7, 0-5, 0-4, 0-2, or 0 modified nucleotides. In one embodiment, N$_b$ is 0, 1, 2, 3, 4, 5, or 6 Each N$_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

   (Ia).

When the sense strand is represented by formula (Ia), each N$_a$ independently can represent an oligonucleotide sequence comprising 2-20, 2-15, or 2-10 modified nucleotides.

In one embodiment, the antisense strand sequence of the RNAi may be represented by formula (II):

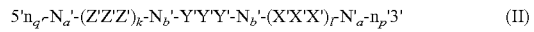   (II)

wherein:
k and l are each independently 0 or 1;
p' and q' are each independently 0-6;
each N$_a$' independently represents an oligonucleotide sequence comprising 0-25 modified nucleotides, each sequence comprising at least two differently modified nucleotides;
each N$_b$' independently represents an oligonucleotide sequence comprising 0-10 modified nucleotides;
each n$_p$' and n$_q$' independently represent an overhang nucleotide;

wherein $N_b'$ and Y' do not have the same modification; and

X'X'X', Y'Y'Y', and Z'Z'Z' each independently represent one motif of three identical modifications on three consecutive nucleotides.

In some embodiments, the $N_a'$ or $N_b'$ comprises modifications of alternating pattern.

The Y'Y'Y' motif occurs at or near the cleavage site of the antisense strand. For example, when the dsRNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the first nucleotide, from the 5'-end; or optionally, the count starting at the first paired nucleotide within the duplex region, from the 5'-end. In one embodiment, the Y'Y'Y' motif occurs at positions 11, 12, 13.

In certain embodiments, Y'Y'Y' motif is all 2'-OMe modified nucleotides.

In certain embodiments, k is 1 and l is 0, or k is 0 and l is 1, or both k and l are 1.

The antisense strand can therefore be represented by the following formulas:

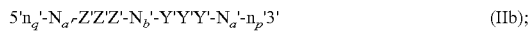  (IIb);

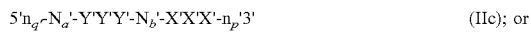  (IIc); or

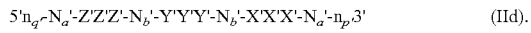  (IId).

When the antisense strand is represented by formula (IIb), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides. In one embodiment, $N_b$ is 0, 1, 2, 3, 4, 5, or 6.

In other embodiments, k is 0 and l is 0 and the antisense strand may be represented by the formula:

  (Ia).

When the antisense strand is represented as formula (IIa), each $N_a'$ independently represents an oligonucleotide sequence comprising 2-20, 2-15, or 2-10 modified nucleotides. Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y', and Z', in particular, may represent a 2'-O-methyl modification or a 2'-fluoro modification.

In some embodiments, the sense strand of the dsRNAi agent may contain YYY motif occurring at 9, 10, and 11 positions of the strand when the duplex region is 21 nt, the count starting from the first nucleotide from the 5'-end, or optionally, the count starting at the first paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may contain Y'Y'Y' motif occurring at positions 11, 12, 13 of the strand, the count starting from the first nucleotide from the 5'-end, or optionally, the count starting at the first paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, the dsRNAi agents for use in the methods of the invention may comprise a sense strand and an antisense strand, each strand having 14 to 30 nucleotides, the iRNA duplex represented by formula (III):

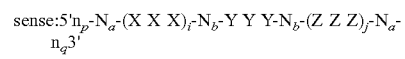

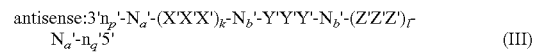  (III)

wherein:
j, k, and l are each independently 0 or 1;
p, p', q, and q' are each independently 0-6;
each $N_a$ and $N_a'$ independently represents an oligonucleotide sequence comprising 0-25 modified nucleotides, each sequence comprising at least two differently modified nucleotides;
each $N_b$ and $N_b'$ independently represents an oligonucleotide sequence comprising 0-10 modified nucleotides;
wherein each $n_p'$, $n_p$, $n_q'$, and $n_q$, each of which may or may not be present, independently represents an overhang nucleotide; and
XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming an iRNA duplex include the formulas below:

  (IIIa)

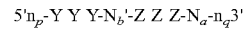

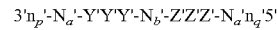  (IIIb)

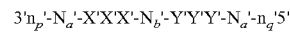  (IIIc)

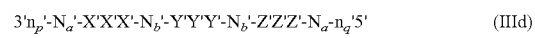  (IIId)

When the dsRNAi agent is represented by formula (IIIa), each $N_a$ independently represents an oligonucleotide sequence comprising 2-20, 2-15, or 2-10 modified nucleotides.

When the dsRNAi agent is represented by formula (IIIb), each $N_b$ independently represents an oligonucleotide sequence comprising 1-10, 1-7, 1-5, or 1-4 modified nucleotides. Each $N_a$ independently represents an oligonucleotide sequence comprising 2-20, 2-15, or 2-10 modified nucleotides.

When the dsRNAi agent is represented as formula (IIIc), each $N_b$, $N_b'$ independently represents an oligonucleotide sequence comprising 0-10, 0-7, 0-10, 0-7, 0-5, 0-4, 0-2, or 0 modified nucleotides. Each $N_a$ independently represents an oligonucleotide sequence comprising 2-20, 2-15, or 2-10 modified nucleotides.

When the dsRNAi agent is represented as formula (IIId), each $N_b$, $N_b'$ independently represents an oligonucleotide sequence comprising 0-10, 0-7, 0-10, 0-7, 0-5, 0-4, 0-2, or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$, and $N_b'$ independently comprises modifications of alternating pattern.

Each of X, Y, and Z in formulas (III), (IIIa), (IIIb), (IIIc), and (IIId) may be the same or different from each other.

When the dsRNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the dsRNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the dsRNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In certain embodiments, the modification on the Y nucleotide is different than the modification on the Y' nucleotide, the modification on the Z nucleotide is different than the modification on the Z' nucleotide, or the modification on the X nucleotide is different than the modification on the X' nucleotide.

In certain embodiments, when the dsRNAi agent is represented by formula (IIId), the $N_a$ modifications are 2'-O-methyl or 2'-fluoro modifications. In other embodiments, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more GalNAc derivatives attached through a bivalent or trivalent branched linker (described below). In other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, when the dsRNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, the dsRNAi agent is a multimer containing at least two duplexes represented by formula (III), (IIIa), (IIIb), (Mc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, the dsRNAi agent is a multimer containing three, four, five, six, or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two dsRNAi agents represented by at least one of formulas (III), (IIIa), (IIIb), (Mc), and (IIId) are linked to each other at the 5' end, and one or both of the 3' ends, and are optionally conjugated to a ligand. Each of the agents can target the same gene or two different genes; or each of the agents can target same gene at two different target sites.

In certain embodiments, an RNAi agent of the invention may contain a low number of nucleotides containing a 2'-fluoro modification, e.g., 10 or fewer nucleotides with 2'-fluoro modification. For example, the RNAi agent may contain 10, 9, 8, 7, 6, 5, 4, 3, 2, 1 or 0 nucleotides with a 2'-fluoro modification. In a specific embodiment, the RNAi agent of the invention contains 10 nucleotides with a 2'-fluoro modification, e.g., 4 nucleotides with a 2'-fluoro modification in the sense strand and 6 nucleotides with a 2'-fluoro modification in the antisense strand. In another specific embodiment, the RNAi agent of the invention contains 6 nucleotides with a 2'-fluoro modification, e.g., 4 nucleotides with a 2'-fluoro modification in the sense strand and 2 nucleotides with a 2'-fluoro modification in the antisense strand.

In other embodiments, an RNAi agent of the invention may contain an ultra low number of nucleotides containing a 2'-fluoro modification, e.g., 2 or fewer nucleotides containing a 2'-fluoro modification. For example, the RNAi agent may contain 2, 1 of 0 nucleotides with a 2'-fluoro modification. In a specific embodiment, the RNAi agent may contain 2 nucleotides with a 2'-fluoro modification, e.g., 0 nucleotides with a 2-fluoro modification in the sense strand and 2 nucleotides with a 2'-fluoro modification in the antisense strand.

Various publications describe multimeric iRNAs that can be used in the methods of the invention. Such publications include WO2007/091269, U.S. Pat. No. 7,858,769, WO2010/141511, WO2007/117686, WO2009/014887, and WO2011/031520 the entire contents of each of which are hereby incorporated herein by reference.

In certain embodiments, the compositions and methods of the disclosure include a vinyl phosphonate (VP) modification of an RNAi agent as described herein. In exemplary embodiments, a 5' vinyl phosphonate modified nucleotide of the disclosure has the structure:

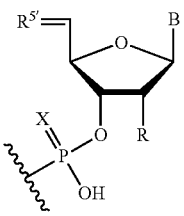

wherein X is O or S;
R is hydrogen, hydroxy, fluoro, or $C_{1-20}$alkoxy (e.g., methoxy or n-hexadecyloxy);
$R^{5'}$ is =C(H)—P(O)(OH)$^2$ and the double bond between the C5' carbon and $R^{5'}$ is in the E or Z orientation (e.g., E orientation); and
B is a nucleobase or a modified nucleobase, optionally where B is adenine, guanine, cytosine, thymine, or uracil.

A vinyl phosphonate of the instant disclosure may be attached to either the antisense or the sense strand of a dsRNA of the disclosure. In certain embodiments, a vinyl phosphonate of the instant disclosure is attached to the antisense strand of a dsRNA, optionally at the 5' end of the antisense strand of the dsRNA.

Vinyl phosphonate modifications are also contemplated for the compositions and methods of the instant disclosure. An exemplary vinyl phosphonate structure includes the preceding structure, where R5' is =C(H)—OP(O)(OH)$_2$ and the double bond between the C5' carbon and R5' is in the E or Z orientation (e.g., E orientation).

As described in more detail below, the iRNA that contains conjugations of one or more carbohydrate moieties to an iRNA can optimize one or more properties of the iRNA. In many cases, the carbohydrate moiety will be attached to a modified subunit of the iRNA. For example, the ribose sugar of one or more ribonucleotide subunits of a iRNA can be replaced with another moiety, e.g., a non-carbohydrate (such as, cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," such as, two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, or polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The iRNA may be conjugated to a ligand via a carrier, wherein the carrier can be cyclic group or acyclic group. In one embodiment, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl, and decalin. In one embodiment, the acyclic group is a serinol backbone or diethanolamine backbone.

i. Thermally Destabilizing Modifications

In certain embodiments, a dsRNA molecule can be optimized for RNA interference by incorporating thermally destabilizing modifications in the seed region of the antisense strand. As used herein "seed region" means at positions 2-9 of the 5'-end of the referenced strand. For example, thermally destabilizing modifications can be incorporated in the seed region of the antisense strand to reduce or inhibit off-target gene silencing.

The term "thermally destabilizing modification(s)" includes modification(s) that would result with a dsRNA with a lower overall melting temperature ($T_m$) than the $T_m$ of the dsRNA without having such modification(s). For example, the thermally destabilizing modification(s) can decrease the $T_m$ of the dsRNA by 1-4° C., such as one, two, three or four degrees Celcius. And, the term "thermally destabilizing nucleotide" refers to a nucleotide containing one or more thermally destabilizing modifications.

It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5' region of the antisense strand. In some embodiments, one or more thermally destabilizing modification(s) of the duplex is/are located in positions 2-9, such as, positions 4-8, from the 5'-end of the antisense strand. In some further embodiments, the thermally destabilizing modification(s) of the duplex is/are located at position 6, 7 or 8 from the 5'-end of the antisense strand. In still some further embodiments, the thermally destabilizing modification of the duplex is located at position 7 from the 5'-end of the antisense strand. In some embodiments, the thermally destabilizing modification of the duplex is located at position 2, 3, 4, 5 or 9 from the 5'-end of the antisense strand.

An iRNA agent comprises a sense strand and an antisense strand, each strand having 14 to 40 nucleotides. The RNAi agent may be represented by formula (L):

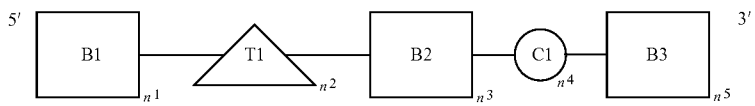

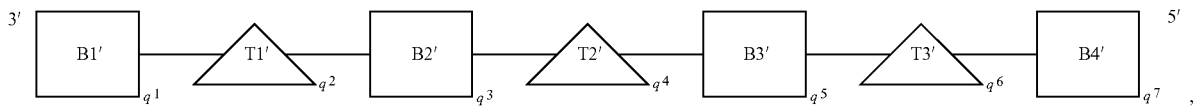

(L)

In formula (L), B1, B2, B3, B1', B2', B3', and B4' each are independently a nucleotide containing a modification selected from the group consisting of 2'-O-alkyl, 2'-substituted alkoxy, 2'-substituted alkyl, 2'-halo, ENA, and BNA/LNA. In one embodiment, B1, B2, B3, B1', B2', B3', and B4' each contain 2'-OMe modifications. In one embodiment, B1, B2, B3, B1', B2', B3', and B4' each contain 2'-OMe or 2'-F modifications. In one embodiment, at least one of B1, B2, B3, B1', B2', B3', and B4' contain 2'-O-N-methylacetamido (2'-O-NMA, 2'O—CH$_2$C(O)N(Me)H) modification.

C1 is a thermally destabilizing nucleotide placed at a site opposite to the seed region of the antisense strand (i.e., at positions 2-8 of the 5'-end of the antisense strand). For example, C1 is at a position of the sense strand that pairs with a nucleotide at positions 2-8 of the 5'-end of the antisense strand. In one example, C1 is at position 15 from the 5'-end of the sense strand. C1 nucleotide bears the thermally destabilizing modification which can include abasic modification; mismatch with the opposing nucleotide in the duplex; and sugar modification such as 2'-deoxy modification or acyclic nucleotide e.g., unlocked nucleic acids (UNA) or glycerol nucleic acid (GNA). In one embodiment, C1 has thermally destabilizing modification selected from the group consisting of: i) mismatch with the opposing nucleotide in the antisense strand; ii) abasic modification selected from the group consisting of:

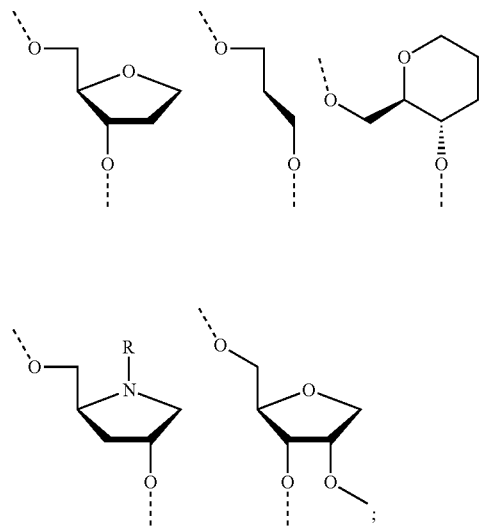

and iii) sugar modification selected from the group consisting of:

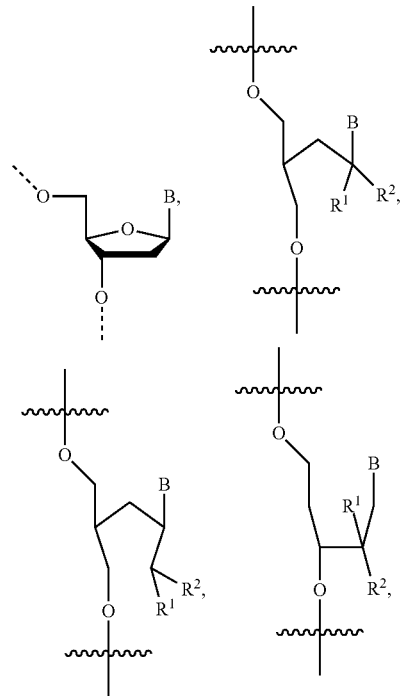

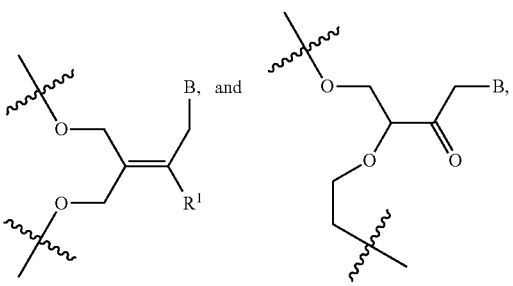

wherein B is a modified or unmodified nucleobase, R$^1$ and R$^2$ independently are H, halogen, OR$_3$, or alkyl; and R$_3$ is H, alkyl, cycloalkyl, aryl, aralkyl, heteroaryl or sugar. In one embodiment, the thermally destabilizing modification in C1 is a mismatch selected from the group consisting of G:G, G:A, G:U, G:T, A:A, A:C, C:C, C:U, C:T, U:U, T:T, and U:T; and optionally, at least one nucleobase in the mismatch pair is a 2'-deoxy nucleobase. In one example, the thermally destabilizing modification in C1 is GNA or

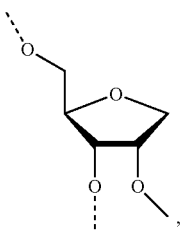

T1, T1', T2', and T3' each independently represent a nucleotide comprising a modification providing the nucleotide a steric bulk that is less or equal to the steric bulk of a 2'-OMe modification. A steric bulk refers to the sum of steric effects of a modification. Methods for determining steric effects of a modification of a nucleotide are known to one skilled in the art. The modification can be at the 2' position of a ribose sugar of the nucleotide, or a modification to a non-ribose nucleotide, acyclic nucleotide, or the backbone of the nucleotide that is similar or equivalent to the 2' position of the ribose sugar, and provides the nucleotide a steric bulk that is less than or equal to the steric bulk of a 2'-OMe modification. For example, T1, T1', T2', and T3' are each independently selected from DNA, RNA, LNA, 2'-F, and 2'-F-5'-methyl. In one embodiment, T1 is DNA. In one embodiment, T1' is DNA, RNA or LNA. In one embodiment, T2' is DNA or RNA. In one embodiment, T3' is DNA or RNA.

$n^1$, $n^3$, and $q^1$ are independently 4 to 15 nucleotides in length.

$n^5$, $q^3$, and $q^7$ are independently 1-6 nucleotide(s) in length.

$n^4$, $q^2$, and $q^6$ are independently 1-3 nucleotide(s) in length; alternatively, $n^4$ is 0.

$q^5$ is independently 0-10 nucleotide(s) in length.

$n^2$ and $q^4$ are independently 0-3 nucleotide(s) in length.

Alternatively, $n^4$ is 0-3 nucleotide(s) in length.

In one embodiment, $n^4$ can be 0. In one example, $n^4$ is 0, and $q^2$ and $q^6$ are 1. In another example, $n^4$ is 0, and $q^2$ and $q^6$ are 1, with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$, $q^2$, and $q^6$ are each 1.

In one embodiment, $n^2$, $n^4$, $q^2$, $q^4$, and $q^6$ are each 1.

In one embodiment, C1 is at position 14-17 of the 5'-end of the sense strand, when the sense strand is 19-22 nucleotides in length, and $n^4$ is 1. In one embodiment, C1 is at position 15 of the 5'-end of the sense strand In one embodiment, T3' starts at position 2 from the 5' end of the antisense strand. In one example, T3' is at position 2 from the 5' end of the antisense strand and $q^6$ is equal to 1.

In one embodiment, T1' starts at position 14 from the 5' end of the antisense strand. In one example, T1' is at position 14 from the 5' end of the antisense strand and $q^2$ is equal to 1.

In an exemplary embodiment, T3' starts from position 2 from the 5' end of the antisense strand and T1' starts from position 14 from the 5' end of the antisense strand. In one example, T3' starts from position 2 from the 5' end of the antisense strand and $q^6$ is equal to 1 and T1' starts from position 14 from the 5' end of the antisense strand and $q^2$ is equal to 1.

In one embodiment, T1' and T3' are separated by 11 nucleotides in length (i.e. not counting the T1' and T3' nucleotides).

In one embodiment, T1' is at position 14 from the 5' end of the antisense strand. In one example, T1' is at position 14 from the 5' end of the antisense strand and $q^2$ is equal to 1, and the modification at the 2' position or positions in a non-ribose, acyclic or backbone that provide less steric bulk than a 2'-OMe ribose.

In one embodiment, T3' is at position 2 from the 5' end of the antisense strand. In one example, T3' is at position 2 from the 5' end of the antisense strand and $q^6$ is equal to 1, and the modification at the 2' position or positions in a non-ribose, acyclic or backbone that provide less than or equal to steric bulk than a 2'-OMe ribose.

In one embodiment, T1 is at the cleavage site of the sense strand. In one example, T1 is at position 11 from the 5' end of the sense strand, when the sense strand is 19-22 nucleotides in length, and $n^2$ is 1. In an exemplary embodiment, T1 is at the cleavage site of the sense strand at position 11 from the 5' end of the sense strand, when the sense strand is 19-22 nucleotides in length, and $n^2$ is 1.

In one embodiment, T2' starts at position 6 from the 5' end of the antisense strand. In one example, T2' is at positions 6-10 from the 5' end of the antisense strand, and $q^4$ is 1.

In an exemplary embodiment, T1 is at the cleavage site of the sense strand, for instance, at position 11 from the 5' end of the sense strand, when the sense strand is 19-22 nucleotides in length, and $n^2$ is 1; T1' is at position 14 from the 5' end of the antisense strand, and $q^2$ is equal to 1, and the modification to T1' is at the 2' position of a ribose sugar or at positions in a non-ribose, acyclic or backbone that provide less steric bulk than a 2'-OMe ribose; T2' is at positions 6-10 from the 5' end of the antisense strand, and $q^4$ is 1; and T3' is at position 2 from the 5' end of the antisense strand, and $q^6$ is equal to 1, and the modification to T3' is at the 2' position or at positions in a non-ribose, acyclic or backbone that provide less than or equal to steric bulk than a 2'-OMe ribose.

In one embodiment, T2' starts at position 8 from the 5' end of the antisense strand. In one example, T2' starts at position 8 from the 5' end of the antisense strand, and $q^4$ is 2.

In one embodiment, T2' starts at position 9 from the 5' end of the antisense strand. In one example, T2' is at position 9 from the 5' end of the antisense strand, and $q^4$ is 1.

In one embodiment, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within positions 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

The RNAi agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-$PS_2$), 5'-end vinylphosphonate (5'-VP), 5'-end methylphosphonate (MePhos), or 5'-deoxy-5'-C-malonyl

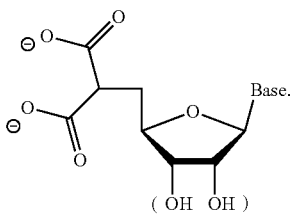

When the 5'-end phosphorus-containing group is 5'-end vinylphosphonate (5'-VP), the 5'-VP can be either 5'-E-VP isomer (i.e., trans-vinylphosphonate,

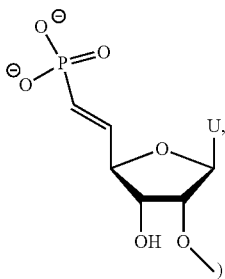

5'-Z-VP isomer (i.e., cis-vinylphosphonate,

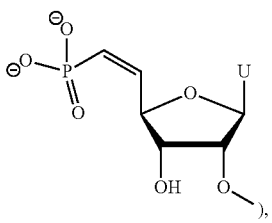

or mixtures thereof.

In one embodiment, the RNAi agent comprises a phosphorus-containing group at the 5'-end of the sense strand. In one embodiment, the RNAi agent comprises a phosphorus-containing group at the 5'-end of the antisense strand.

In one embodiment, the RNAi agent comprises a 5'-P. In one embodiment, the RNAi agent comprises a 5'-P in the antisense strand.

In one embodiment, the RNAi agent comprises a 5'-PS. In one embodiment, the RNAi agent comprises a 5'-PS in the antisense strand.

In one embodiment, the RNAi agent comprises a 5'-VP. In one embodiment, the RNAi agent comprises a 5'-VP in the antisense strand. In one embodiment, the RNAi agent comprises a 5'-E-VP in the antisense strand. In one embodiment, the RNAi agent comprises a 5'-Z-VP in the antisense strand.

In one embodiment, the RNAi agent comprises a 5'-$PS_2$. In one embodiment, the RNAi agent comprises a 5'-$PS_2$ in the antisense strand.

In one embodiment, the RNAi agent comprises a 5'-$PS_2$. In one embodiment, the RNAi agent comprises a 5'-deoxy-5'-C-malonyl in the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^7$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNAi RNA agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof), and a targeting ligand.

In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$ and a targeting ligand. In one embodiment, the 5'-$PS_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^4$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In a particular embodiment, an RNAi agent of the present invention comprises:

(a) a sense strand having:
  (i) a length of 21 nucleotides;
  (ii) an ASGPR ligand attached to the 3'-end, wherein said ASGPR ligand comprises three GalNAc derivatives attached through a trivalent branched linker; and
  (iii) 2'-F modifications at positions 1, 3, 5, 7, 9 to 11, 13, 17, 19, and 21, and 2'-OMe modifications at positions 2, 4, 6, 8, 12, 14 to 16, 18, and 20 (counting from the 5' end); and (b) an antisense strand having:
  (i) a length of 23 nucleotides;
  (ii) 2'-OMe modifications at positions 1, 3, 5, 9, 11 to 13, 15, 17, 19, 21, and 23, and 2'F modifications at positions 2, 4, 6 to 8, 10, 14, 16, 18, 20, and 22 (counting from the 5' end); and
  (iii) phosphorothioate internucleotide linkages between nucleotide positions 21 and 22, and between nucleotide positions 22 and 23 (counting from the 5' end);
  wherein the dsRNA agents have a two nucleotide overhang at the 3'-end of the antisense strand, and a blunt end at the 5'-end of the antisense strand.

In another particular embodiment, an RNAi agent of the present invention comprises:

(a) a sense strand having:
(i) a length of 21 nucleotides;
(ii) an ASGPR ligand attached to the 3'-end, wherein said ASGPR ligand comprises three GalNAc derivatives attached through a trivalent branched linker;
  (iii) 2'-F modifications at positions 1, 3, 5, 7, 9 to 11, 13, 15, 17, 19, and 21, and 2'-OMe modifications at positions 2, 4, 6, 8, 12, 14, 16, 18, and 20 (counting from the 5' end); and
  (iv) phosphorothioate internucleotide linkages between nucleotide positions 1 and 2, and between nucleotide positions 2 and 3 (counting from the 5' end); and (b) an antisense strand having:
  (i) a length of 23 nucleotides;
  (ii) 2'-OMe modifications at positions 1, 3, 5, 7, 9, 11 to 13, 15, 17, 19, and 21 to 23, and 2'F modifications at positions 2, 4, 6, 8, 10, 14, 16, 18, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, 10, and 12 to 21, 2'-F modifications at positions 7, and 9, and a deoxy-nucleotide (e.g. dT) at position 11 (counting from the 5' end); and
  (iv) phosphorothioate internucleotide linkages between nucleotide positions 1 and 2, and between nucleotide positions 2 and 3 (counting from the 5' end); and
(b) an antisense strand having:
  (i) a length of 23 nucleotides;
  (ii) 2'-OMe modifications at positions 1, 3, 7, 9, 11, 13, 15, 17, and 19 to 23, and 2'-F modifications at positions 2, 4 to 6, 8, 10, 12, 14, 16, and 18 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, 10, 12, 14, and 16 to 21, and 2'-F modifications at positions 7, 9, 11, 13, and 15; and
  (iv) phosphorothioate internucleotide linkages between nucleotide positions 1 and 2, and between nucleotide positions 2 and 3 (counting from the 5' end); and
(b) an antisense strand having:
  (i) a length of 23 nucleotides;
  (ii) 2'-OMe modifications at positions 1, 5, 7, 9, 11, 13, 15, 17, 19, and 21 to 23, and 2'-F modifications at positions 2 to 4, 6, 8, 10, 12, 14, 16, 18, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 9, and 12 to 21, and 2'-F modifications at positions 10, and 11; and
  (iv) phosphorothioate internucleotide linkages between nucleotide positions 1 and 2, and between nucleotide positions 2 and 3 (counting from the 5' end); and
(b) an antisense strand having:
  (i) a length of 23 nucleotides;
  (ii) 2'-OMe modifications at positions 1, 3, 5, 7, 9, 11 to 13, 15, 17, 19, and 21 to 23, and 2'-F modifications at positions 2, 4, 6, 8, 10, 14, 16, 18, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-F modifications at positions 1, 3, 5, 7, 9 to 11, and 13, and 2'-OMe modifications at positions 2, 4, 6, 8, 12, and 14 to 21; and
  (iv) phosphorothioate internucleotide linkages between nucleotide positions 1 and 2, and between nucleotide positions 2 and 3 (counting from the 5' end); and
(b) an antisense strand having:
  (i) a length of 23 nucleotides;
  (ii) 2'-OMe modifications at positions 1, 3, 5 to 7, 9, 11 to 13, 15, 17 to 19, and 21 to 23, and 2'-F modifications at positions 2, 4, 8, 10, 14, 16, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1, 2, 4, 6, 8, 12, 14, 15, 17, and 19 to 21, and 2'-F modifications at positions 3, 5, 7, 9 to 11, 13, 16, and 18; and
(iv) phosphorothioate internucleotide linkages between nucleotide positions 1 and 2, and between nucleotide positions 2 and 3 (counting from the 5' end);
and
(b) an antisense strand having:
(i) a length of 25 nucleotides;
(ii) 2'-OMe modifications at positions 1, 4, 6, 7, 9, 11 to 13, 15, 17, and 19 to 23, 2'-F modifications at positions 2, 3, 5, 8, 10, 14, 16, and 18, and deoxy-nucleotides (e.g. dT) at positions 24 and 25 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a four nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, and 12 to 21, and 2'-F modifications at positions 7, and 9 to 11; and
(iv) phosphorothioate internucleotide linkages between nucleotide positions 1 and 2, and between nucleotide positions 2 and 3 (counting from the 5' end);
and
(b) an antisense strand having:
(i) a length of 23 nucleotides;
(ii) 2'-OMe modifications at positions 1, 3 to 5, 7, 8, 10 to 13, 15, and 17 to 23, and 2'-F modifications at positions 2, 6, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, and 12 to 21, and 2'-F modifications at positions 7, and 9 to 11; and
(iv) phosphorothioate internucleotide linkages between nucleotide positions 1 and 2, and between nucleotide positions 2 and 3 (counting from the 5' end);
and
(b) an antisense strand having:
(i) a length of 23 nucleotides;
(ii) 2'-OMe modifications at positions 1, 3 to 5, 7, 10 to 13, 15, and 17 to 23, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 19 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 4, 6, and 10 to 19, and 2'-F modifications at positions 5, and 7 to 9; and
(iv) phosphorothioate internucleotide linkages between nucleotide positions 1 and 2, and between nucleotide positions 2 and 3 (counting from the 5' end);
and
(b) an antisense strand having:
(i) a length of 21 nucleotides;
(ii) 2'-OMe modifications at positions 1, 3 to 5, 7, 10 to 13, 15, and 17 to 21, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 19 and 20, and between nucleotide positions 20 and 21 (counting from the 5' end);
wherein the RNAi agents have a two nucleotide overhang at the 3'-end of the antisense strand, and a blunt end at the 5'-end of the antisense strand.

In certain embodiments, the iRNA for use in the methods of the invention is an agent selected from agents listed in any one of Tables 2, 3, 5, and 6. These agents may further comprise a ligand.

III. iRNAs Conjugated to Ligands

Another modification of the RNA of an iRNA of the invention involves chemically linking to the iRNA one or more ligands, moieties or conjugates that enhance the activity, cellular distribution, or cellular uptake of the iRNA e.g., into a cell. Such moieties include but are not limited to lipid moieties such as a cholesterol moiety (Letsinger et al., *Proc. Natl. Acid. Sci. USA,* 1989, 86: 6553-6556). In other embodiments, the ligand is cholic acid (Manoharan et al., *Biorg. Med. Chem. Let.,* 1994, 4:1053-1060), a thioether, e.g., beryl-S-tritylthiol (Manoharan et al., *Ann. N.Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie*, 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.*, 1995, 36:3651-3654; Shea et al., *Nucl. Acids Res.*, 1990, 18:3777-3783), a polyamine or a polyethylene glycol chain (Manoharan et al., *Nucleosides & Nucleotides*, 1995, 14:969-973), or adamantane acetic acid (Manoharan et al., *Tetrahedron Lett.*, 1995, 36:3651-3654), a palmityl moiety (Mishra et al., *Biochim. Biophys. Acta*, 1995, 1264:229-237), or an octadecylamine or hexylaminocarbonyloxycholesterol moiety (Crooke et al., *J. Pharmacol. Exp. Ther.*, 1996, 277:923-937).

In certain embodiments, a ligand alters the distribution, targeting, or lifetime of an iRNA agent into which it is incorporated. In some embodiments a ligand provides an enhanced affinity for a selected target, e.g., molecule, cell or cell type, compartment, e.g., a cellular or organ compartment, tissue, organ or region of the body, as, e.g., compared to a species absent such a ligand. In some embodiments, ligands do not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolide) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacrylic acid), N-isopropylacrylamide polymers, or polyphosphazine Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic. In certain embodiments, the ligand is a multivalent galactose, e.g., an N-acetyl-galactosamine.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid,O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]2, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxol, vincristine, vinblastine, cytochalasin, nocodazole, jasplakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins, etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin. Oligonucleotides that comprise a number of phosphorothioate linkages are also known to bind to serum protein, thus short oligonucleotides, e.g., oligonucleotides of about 5 bases, 10 bases, 15 bases, or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif.). Any other methods for such synthesis known in the art may additionally or alternatively be employed. It is also known to use similar techniques to prepare other oligonucleotides, such as the phosphorothioates and alkylated derivatives.

In the ligand-conjugated iRNAs and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. In one embodiment, such a lipid or lipid-based molecule binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid based ligand binds HSA. In one embodiment, it binds HSA with a sufficient affinity such that the conjugate will be distributed to a non-kidney tissue. However, it is preferred that the affinity not be so strong that the HSA-ligand binding cannot be reversed.

In other embodiments, the lipid based ligand binds HSA weakly or not at all. In one embodiment, the conjugate will be distributed to the kidney. Other moieties that target to kidney cells can also be used in place of, or in addition to, the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, such as, a helical cell-permeation agent. In one embodiment, the agent is amphipathic. An exemplary agent is a peptide such as that or antennapedia. If the agent is a peptide, it can be modified, including a peptidylmimetic, invertomers, non-peptide or pseudo-peptide linkages, and use of D-amino acids. In one embodiment, the helical agent is an alpha-helical agent, which has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 14). An RFGF analogue (e.g., amino acid sequence AALLPVL-LAAP (SEQ ID NO:15) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:16) and the Drosophila Antennapedia protein (RQIKIWFQNR-RMKWKK (SEQ ID NO:17) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidomimetics may include D-amino acids, as well as synthetic RGD mimics. In addition to RGD, one can use other moieties that target the integrin ligand, e.g., PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA further comprises a carbohydrate. The carbohydrate conjugated iRNA is advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri-, and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In certain embodiments, a carbohydrate conjugate for use in the compositions and methods of the invention is a monosaccharide.

In certain embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein. In some embodiments the GalNAc conjugate is conjugated to the 5' end of the sense strand. In some embodiments, the GalNAc conjugate is conjugated to the iRNA agent (e.g., to the 5' end of the sense strand) via a linker, e.g., a linker as described herein.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In one embodiment, a carbohydrate conjugate for use in the compositions and methods of the invention is selected from the group consisting of:

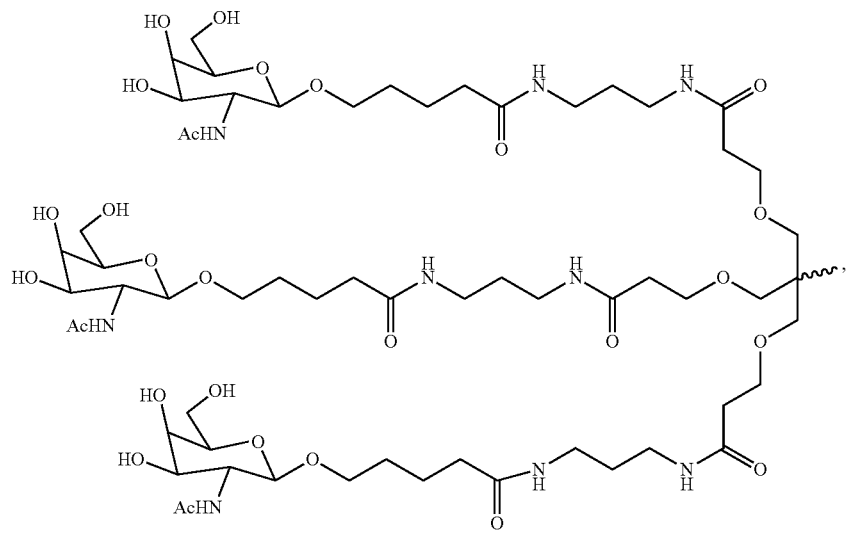

Formula II

-continued
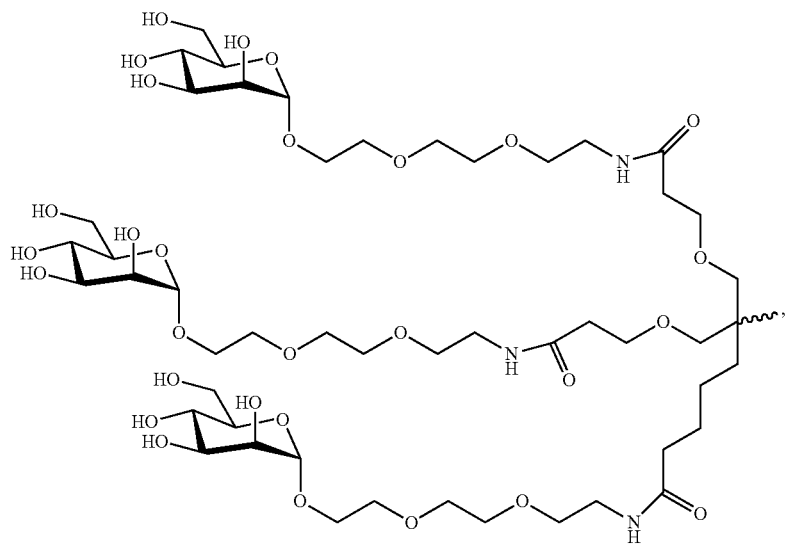
Formula III
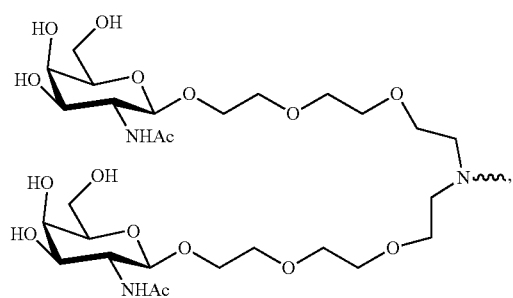
Formula IV
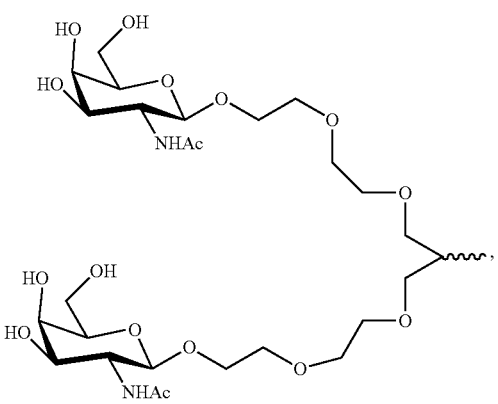
Formula V
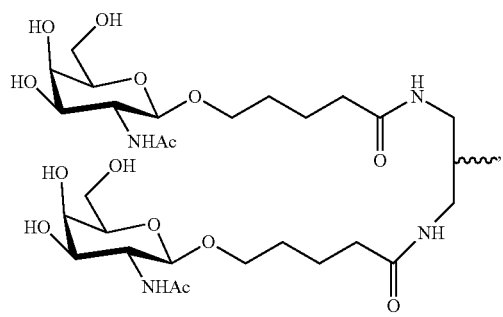
Formula VI
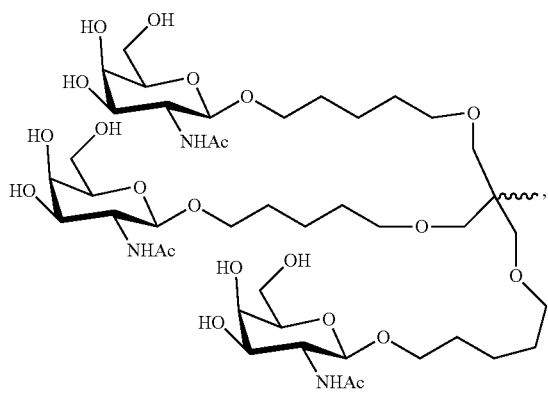
Formula VII
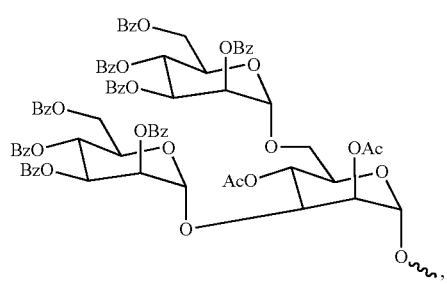
Formula VIII -continued
Formula IX
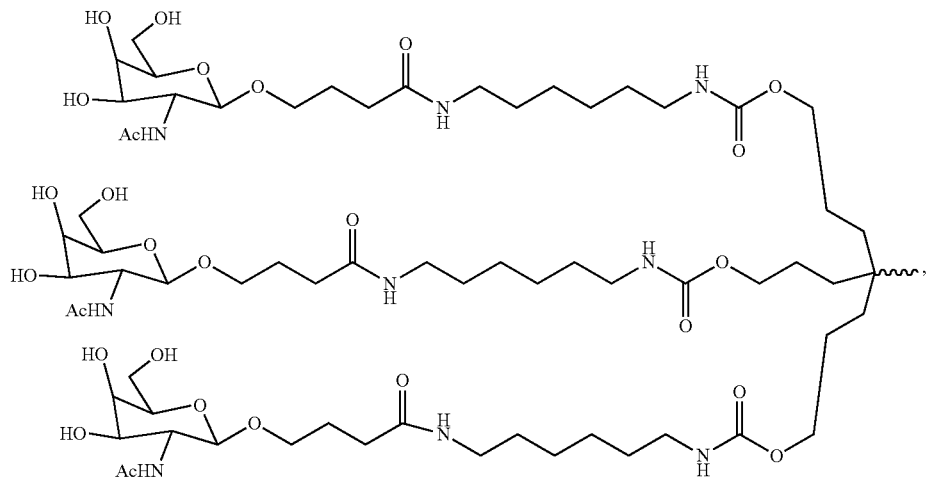
Formula X
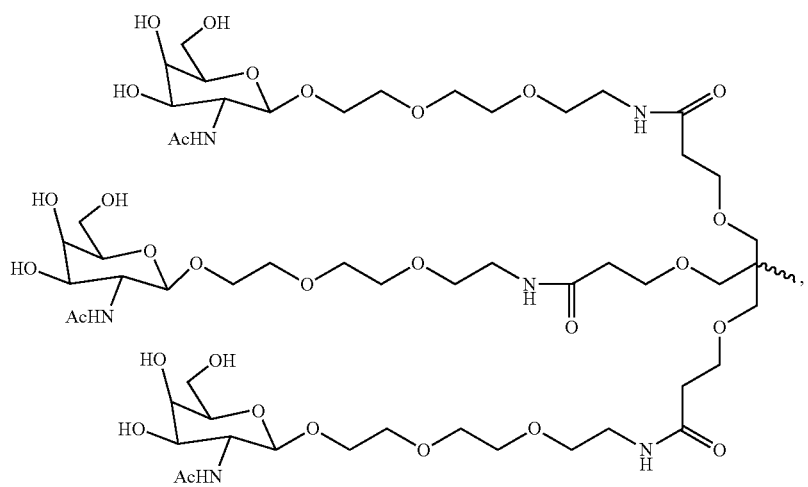
Formula XI
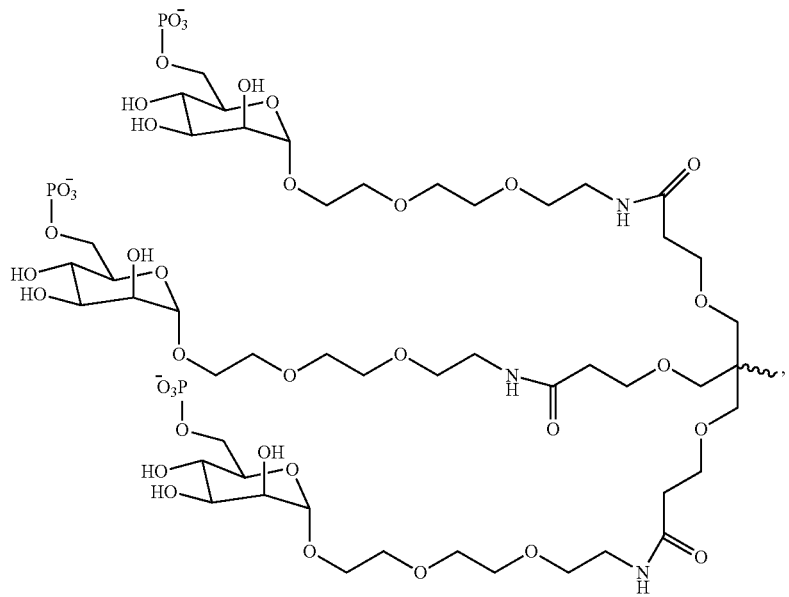

Formula XII
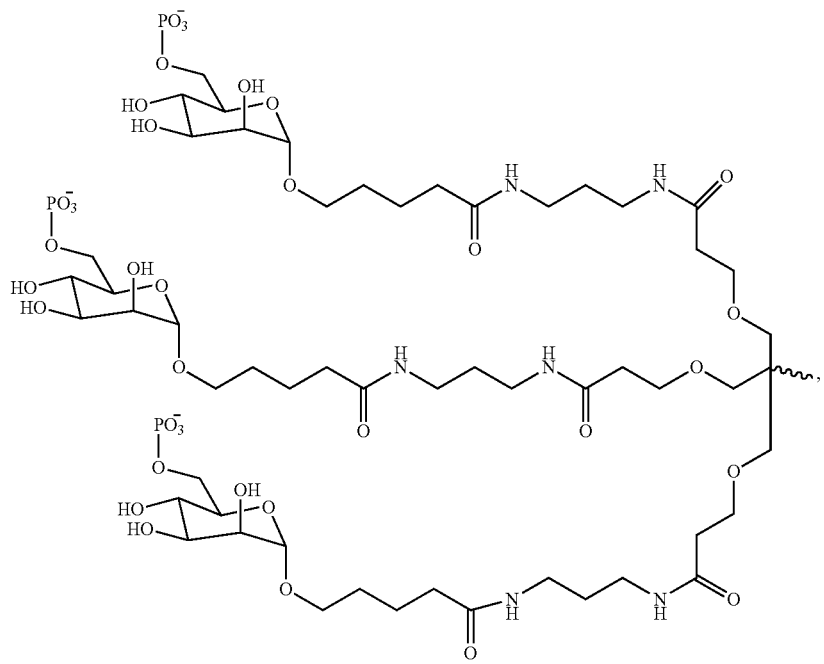
Formula XIII
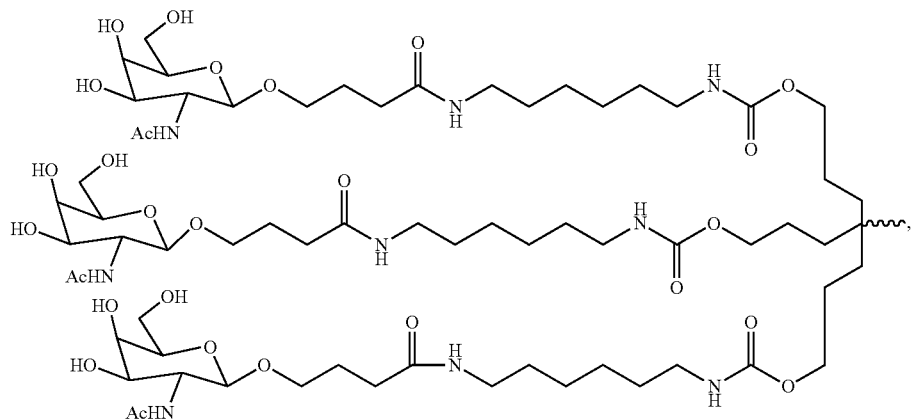
Formula XIV
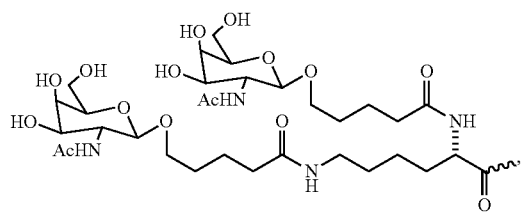
Formula XV
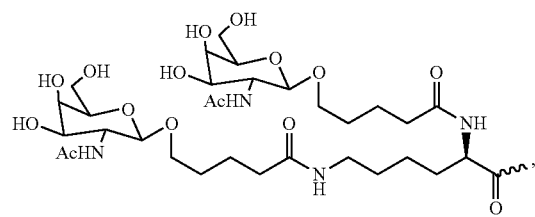
Formula XVI
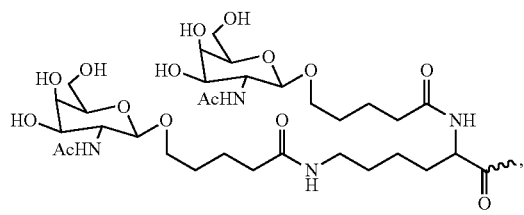
Formula XVII
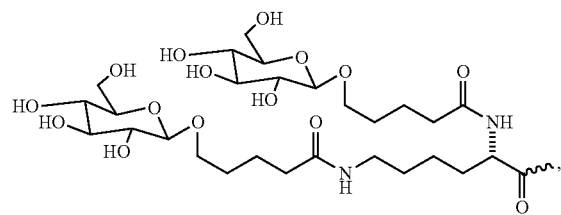

-continued
Formula XVIII
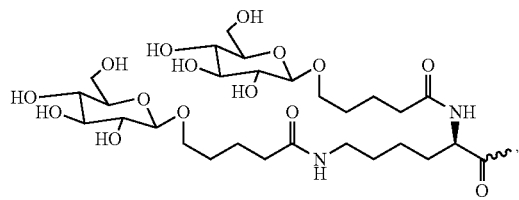
Formula XIX
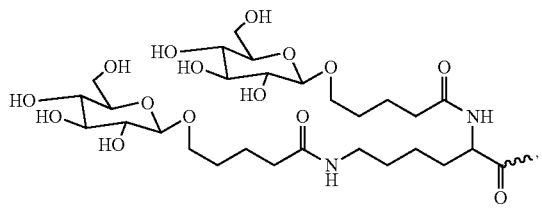
Formula XX
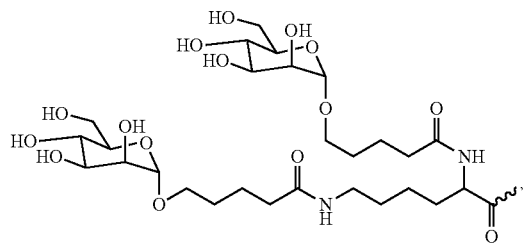
Formula XXI
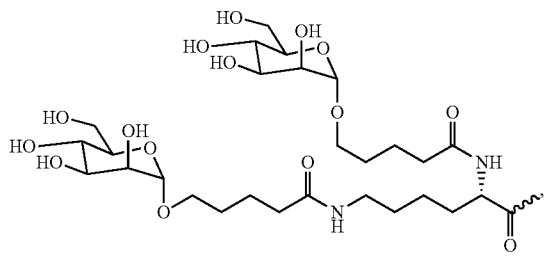
Formula XXII
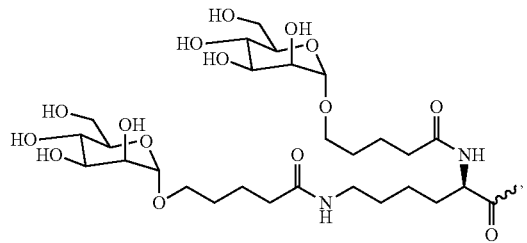
Formula XXIII
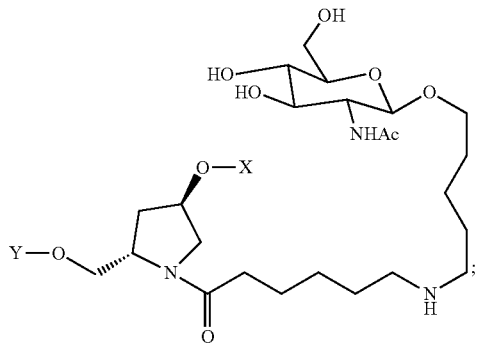

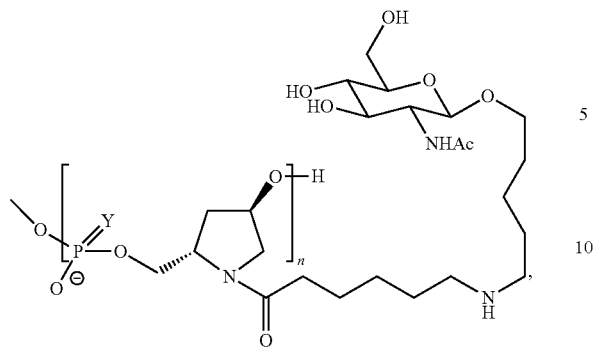
wherein Y is O or S and n is 3-6 (Formula XXIV);
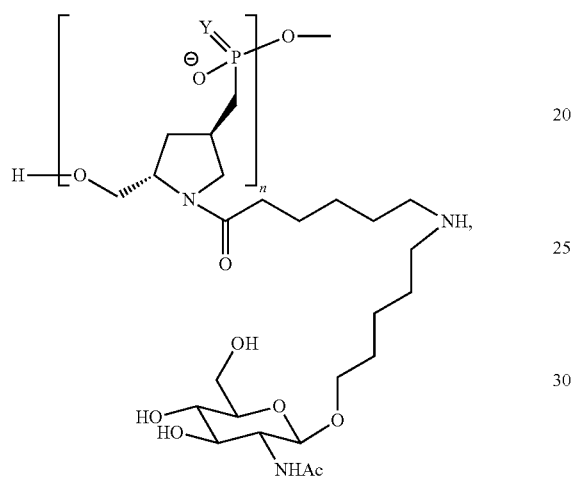
wherein Y is O or S and n is 3-6 (Formula XXV);
Formula XXVI
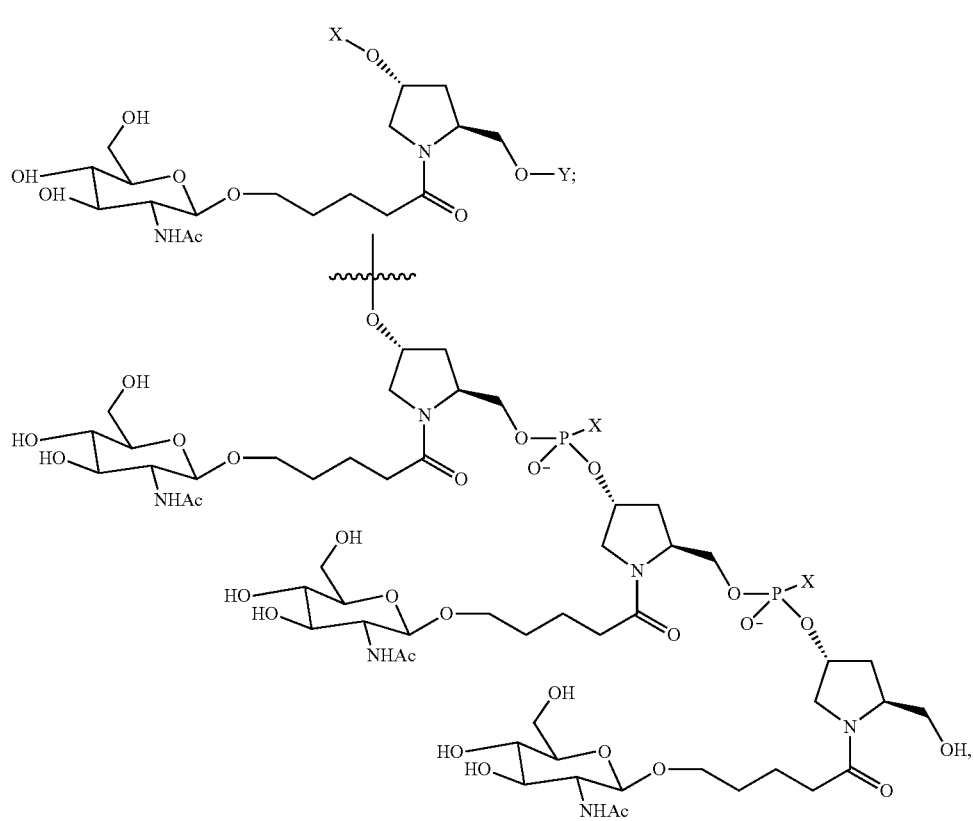

wherein X is O or S (Formula XXVII);

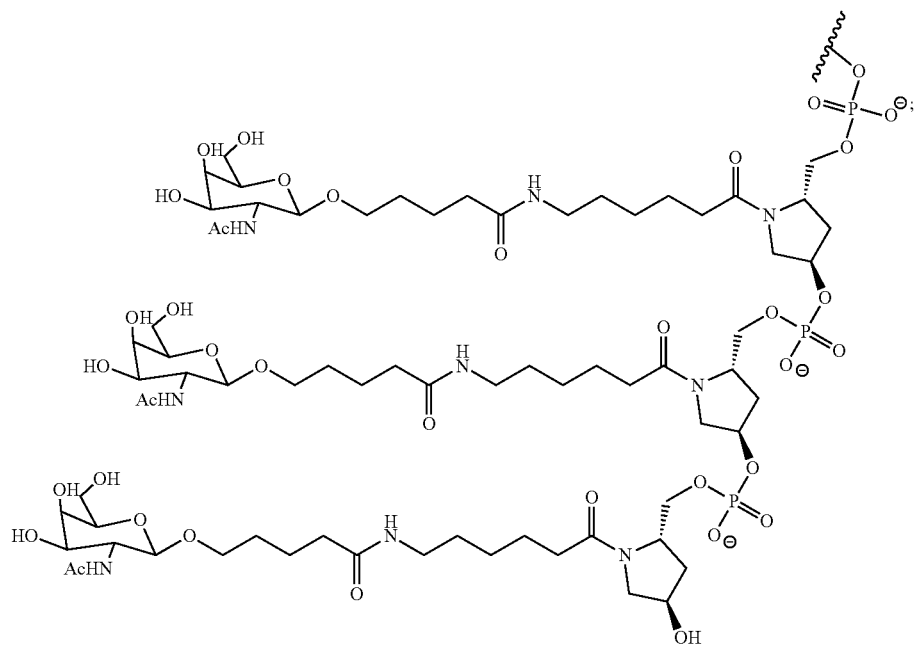
Formula XXVII
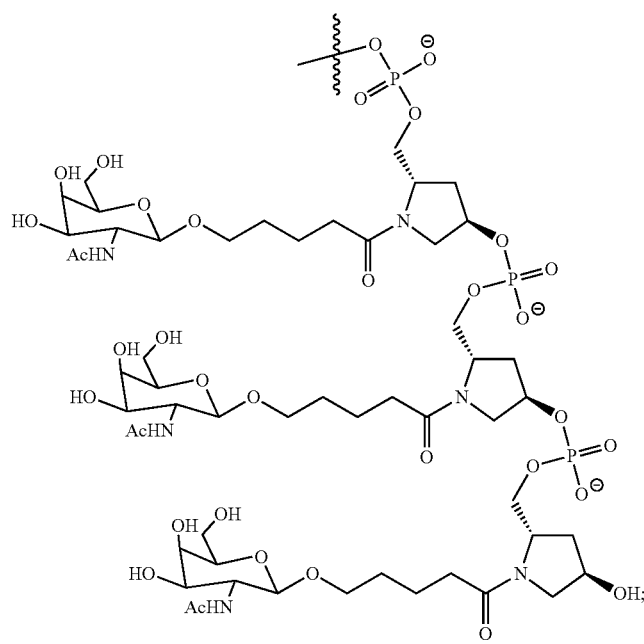
Formula XXIX

Formula XXX
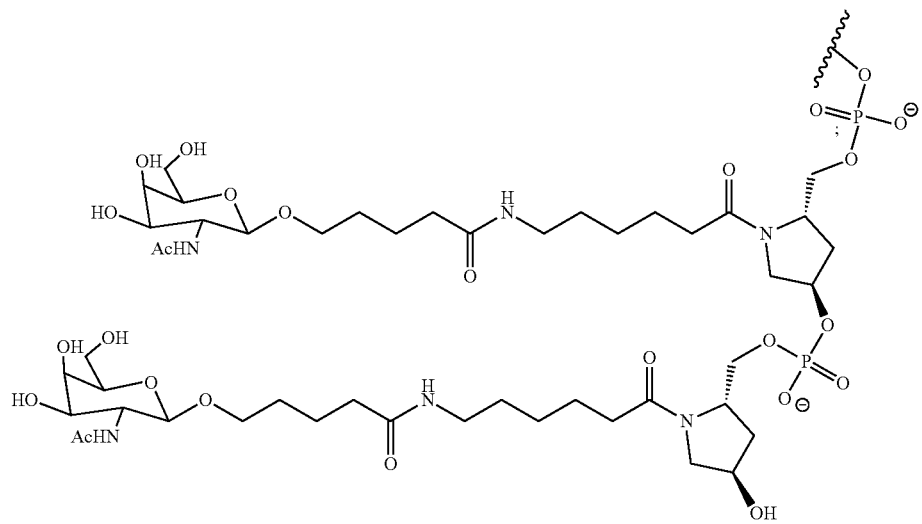
Formula XXXI
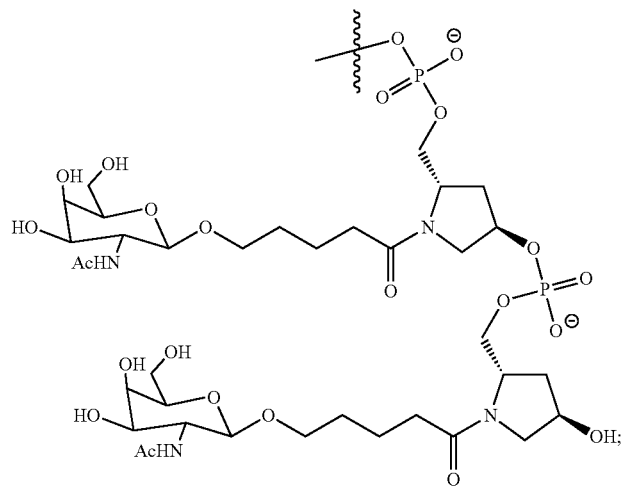
Formula XXXII
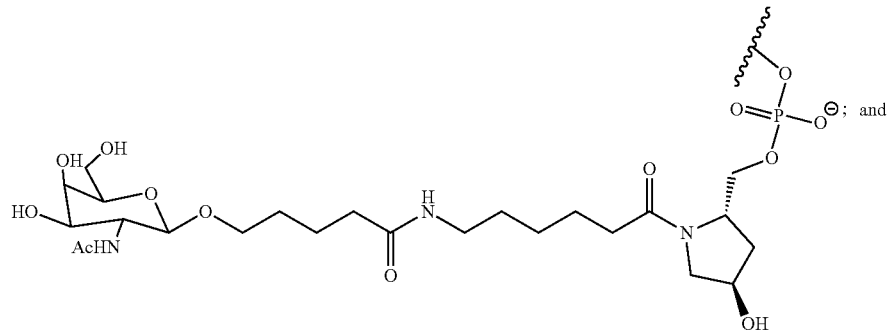
Formula XXXIII
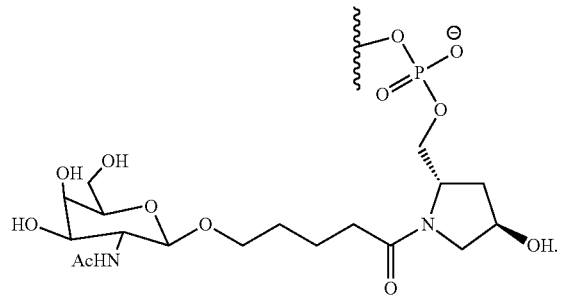

-continued
Formula XXXIV
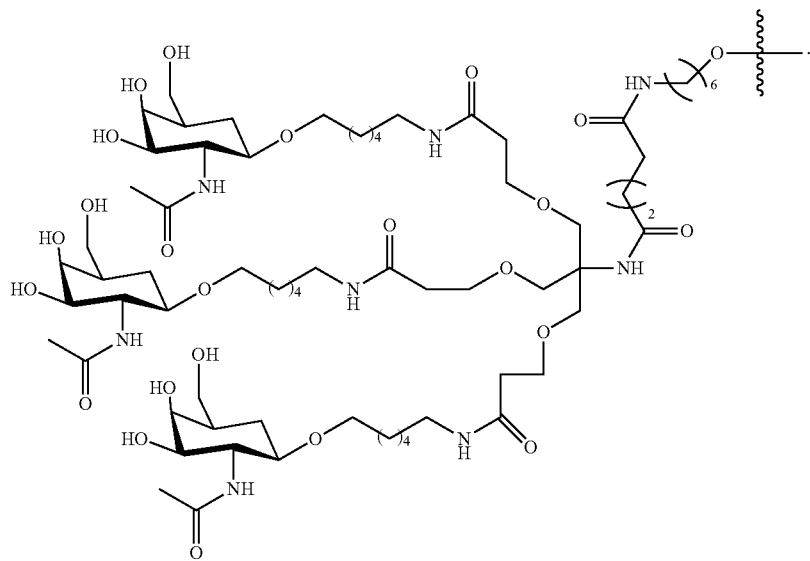
In another embodiment, a carbohydrate conjugate for use in the compositions and methods of the invention is a monosaccharide. In one embodiment, the monosaccharide is an N-acetylgalactosamine, such as
Formula II
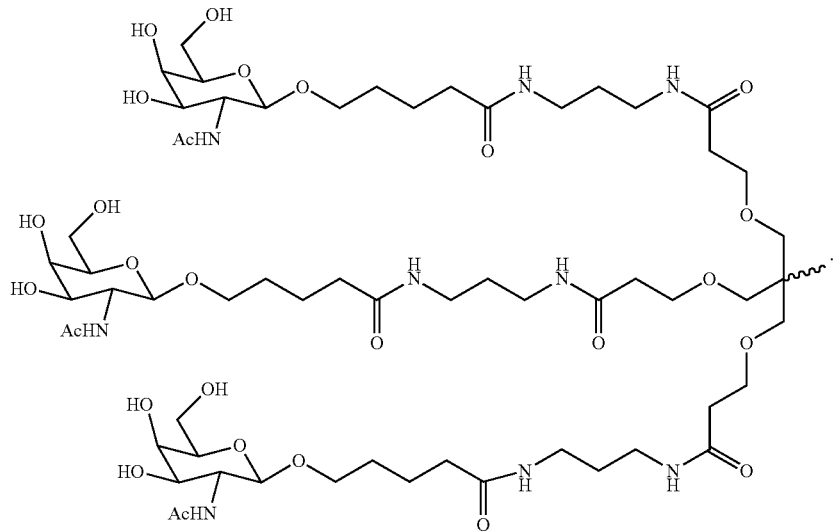

In some embodiments, the RNAi agent is attached to the carbohydrate conjugate via a linker as shown in the following schematic, wherein X is O or S.
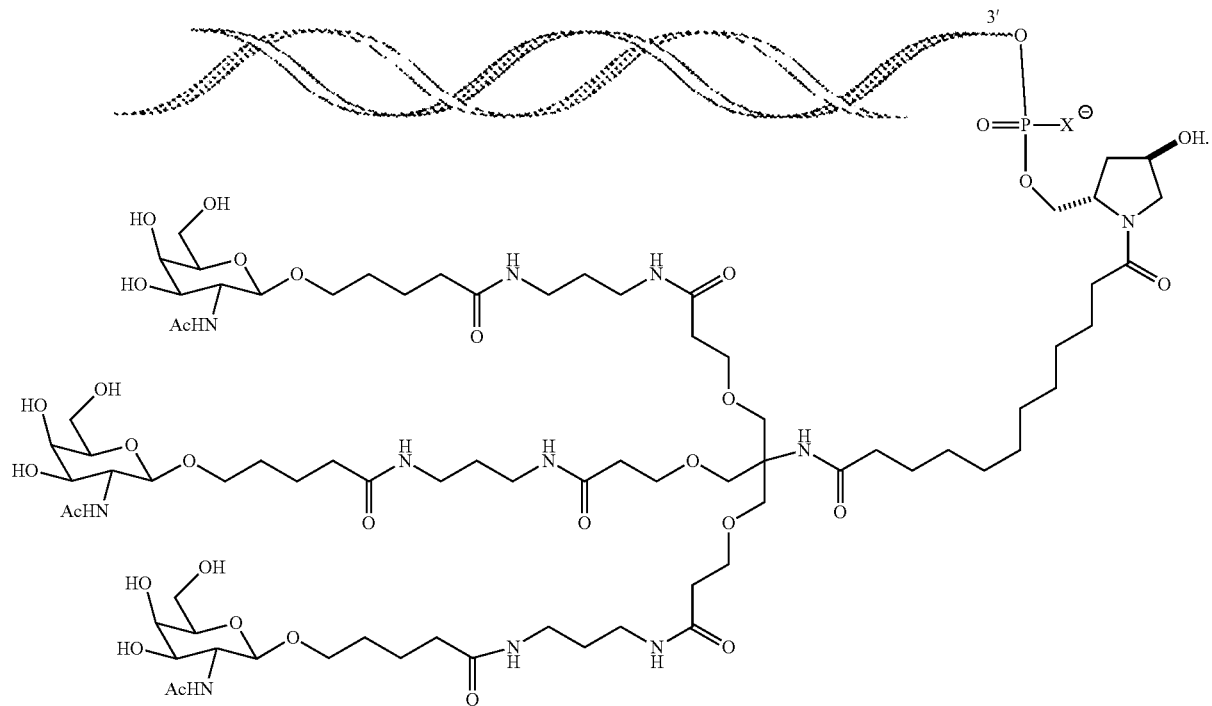
In some embodiments, the RNAi agent is conjugated to L96 as defined in Table 1 and shown below:
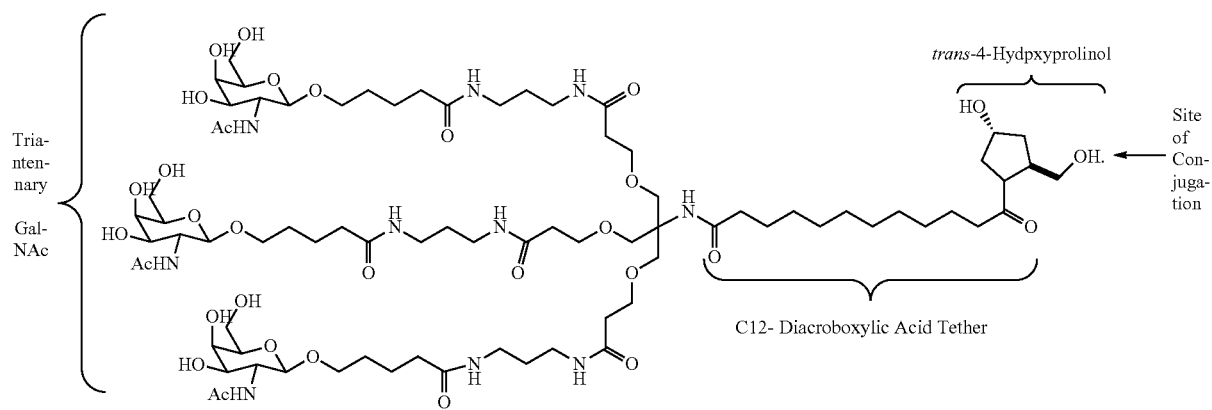

Another representative carbohydrate conjugate for use in the embodiments described herein includes, but is not limited to,

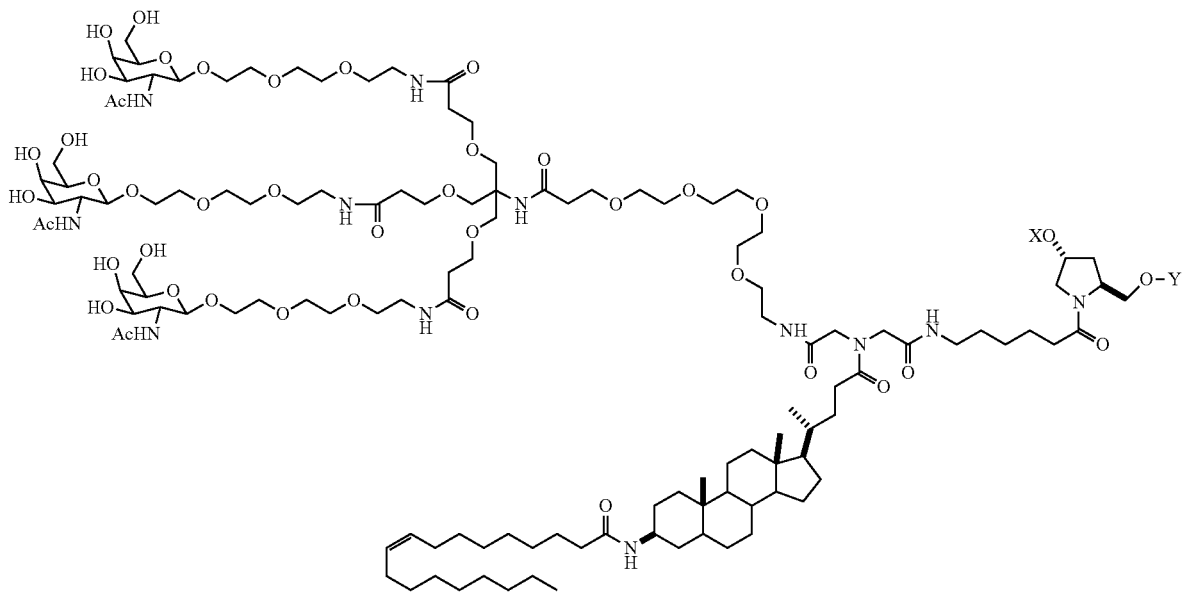

(Formula XXXVI), when one of X or Y is an oligonucleotide, the other is a hydrogen.

In some embodiments, a suitable ligand is a ligand disclosed in WO 2019/055633, the entire contents of which are incorporated herein by reference. In one embodiment the ligand comprises the structure below:

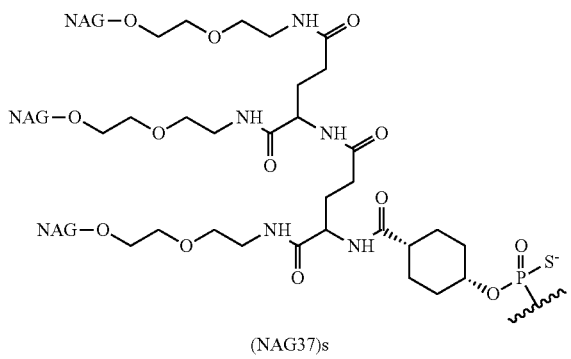

(NAG37)s

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one or more GalNAc or GalNAc derivative attached to the iRNA agent. The GalNAc may be attached to any nucleotide via a linker on the sense strand or antisense strand. The GalNac may be attached to the 5'-end of the sense strand, the 3' end of the sense strand, the 5'-end of the antisense strand, or the 3'-end of the antisense strand.

In one embodiment, the GalNAc is attached to the 3' end of the sense strand, e.g., via a trivalent linker.

In other embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of linkers, e.g., monovalent linkers.

In some embodiments, for example, when the two strands of an iRNA agent of the invention is part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocylylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylherероaryl, which one or more methylenes can be interrupted or terminated by O, S, S(O), SO$_2$, N(R8), C(O), substituted or unsubstituted aryl, substituted or unsubstituted heteroaryl, or substituted or unsubstituted heterocyclic; where R8 is hydrogen, acyl, aliphatic, or substituted aliphatic. In one embodiment, the linker is about 1-24 atoms, 2-24, 3-24, 4-24, 5-24, 6-24, 6-18, 7-18, 8-18, 7-17, 8-17, 6-16, 7-17, or 8-16 atoms.

A cleavable linking group is one which is sufficiently stable outside the cell, but which upon entry into a target cell is cleaved to release the two parts the linker is holding together. In an exemplary embodiment, the cleavable linking group is cleaved at least about 10 times, 20, times, 30 times, 40 times, 50 times, 60 times, 70 times, 80 times, 90 times, or more, or at least 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a selected pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In certain embodiments, useful candidate compounds are cleaved at least about 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In other embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—, wherein Rk at each occurrence can be, independently, C1-C20 alkyl, C1-C20 haloalkyl, C6-C10 aryl, or C7-C12 aralkyl. Exemplary embodiments include —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, and —O—P(S)(H)—S—. In certain embodiments a phosphate-based linking group is —O—P(O)(OH)—O—. These candidates can be evaluated using methods analogous to those described above.\ iii. Acid Cleavable Linking Groups

In other embodiments, a cleavable linker comprises an acid cleavable linking group. An acid cleavable linking group is a linking group that is cleaved under acidic conditions. In certain embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). An exemplary embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In other embodiments, a cleavable linker comprises an ester-based cleavable linking group. An ester-based cleavable linking group is cleaved by enzymes such as esterases and amidases in cells. Examples of ester-based cleavable linking groups include, but are not limited to, esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet other embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynylene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to, (Formula XXXVII)

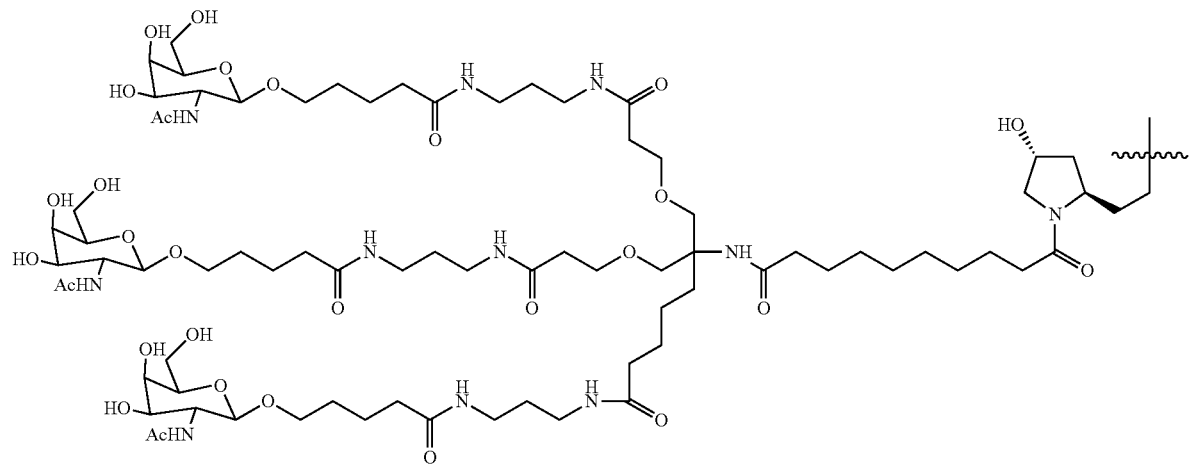

-continued
(Formula XXXVIII)
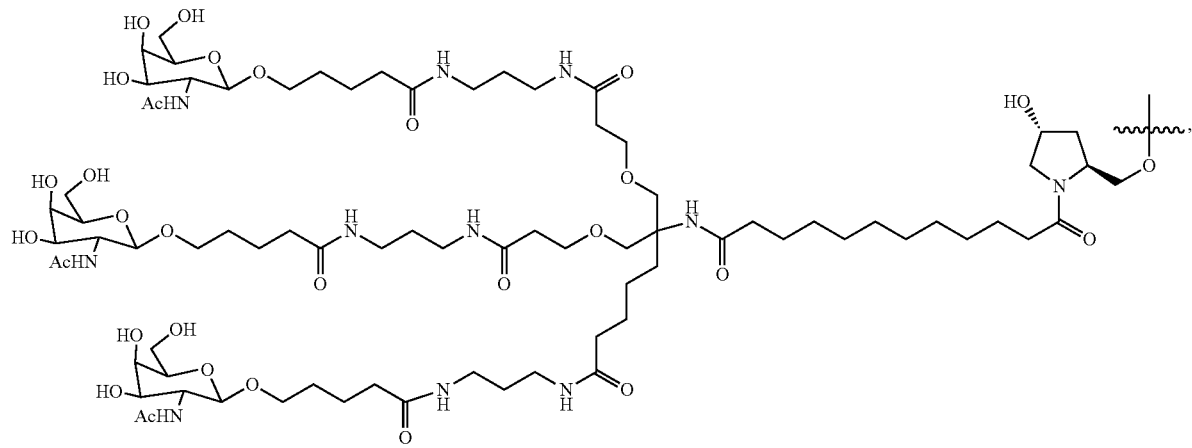
(Formula XXXIX)
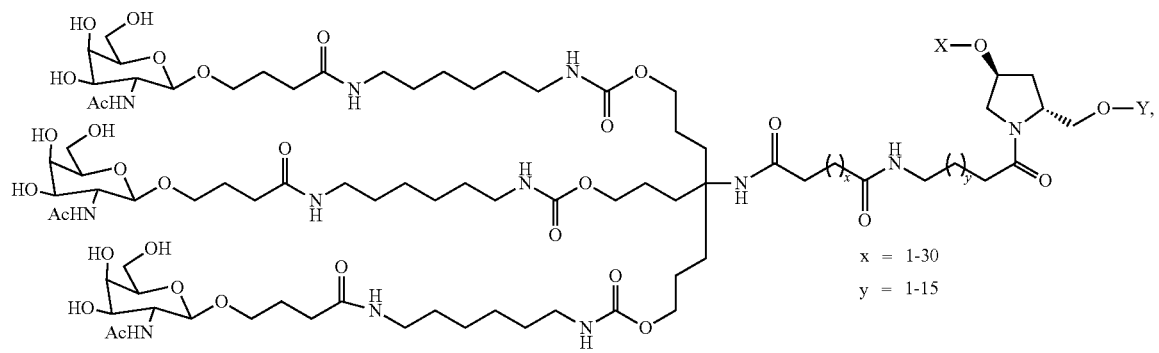
x = 1-30
y = 1-15
(Formula XL)
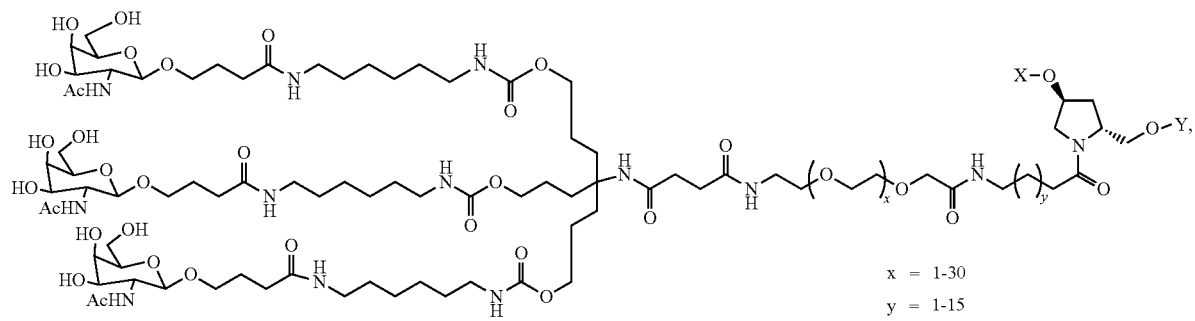
x = 1-30
y = 1-15
(Formula XLI)
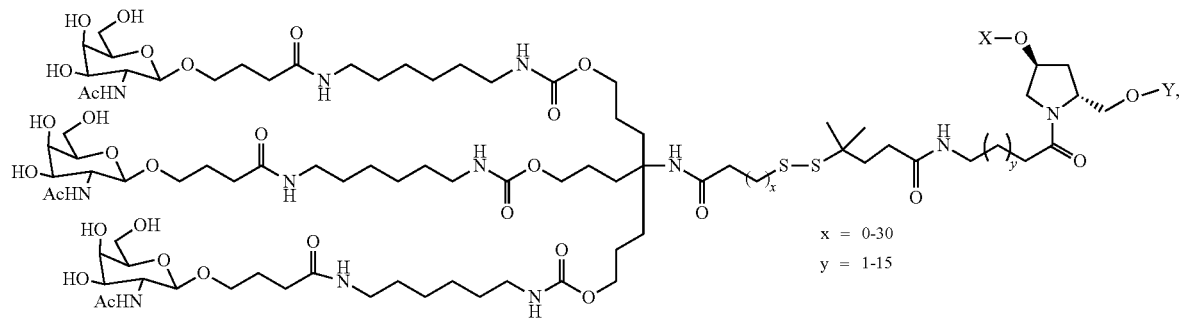
x = 0-30
y = 1-15

(Formula XLII)

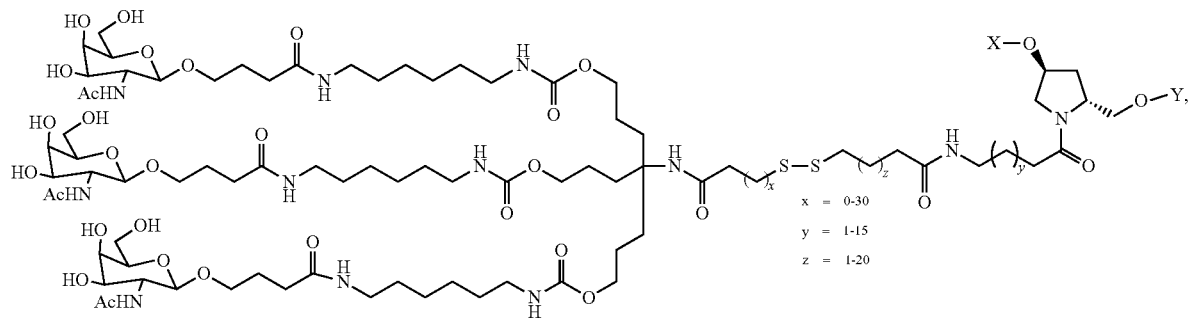

(Formula XLIII)

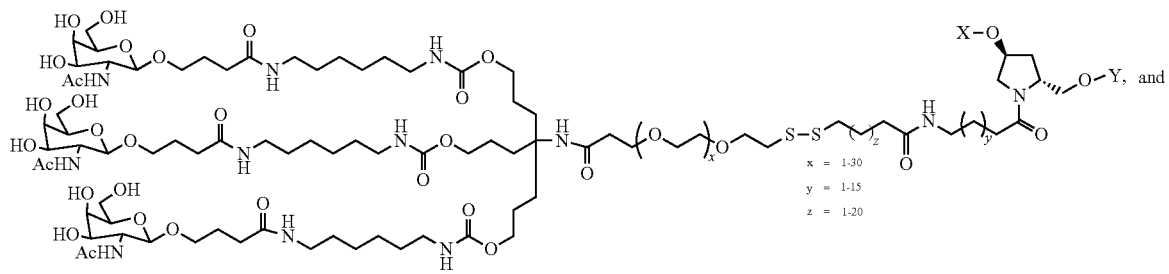

(Formula XLIV)

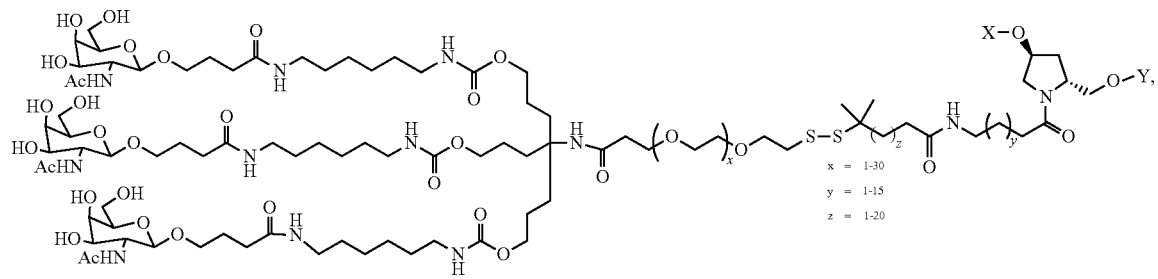

when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XLV)—(XLVIII):

Formula XLV

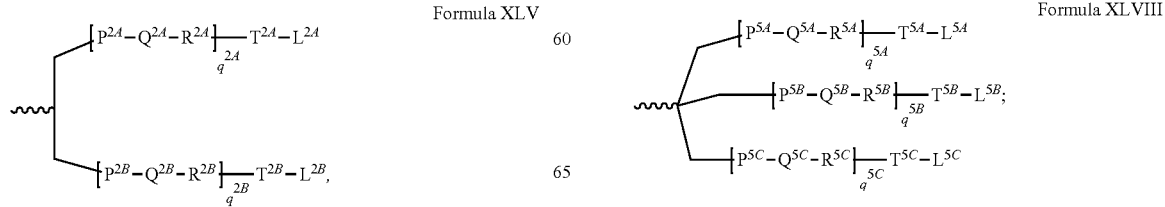

Formula XLVI

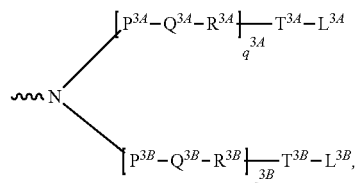

Formula XLVII

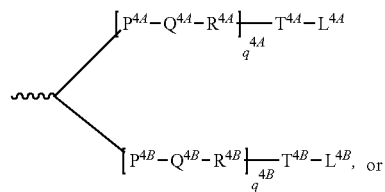

Formula XLVIII wherein:
q2A, q2B, q3A, q3B, q4A, q4B, q5A, q5B and q5C represent independently for each occurrence 0-20 and wherein the repeating unit can be the same or different;

$P^{2A}, P^{2B}, P^{3A}, P^{3B}, P^{4A}, P^{4B}, P^{5A}, P^{5B}, P^{5C}, T^{2A}, T^{2B}, T^{3A}, T^{3B}, T^{4A}, T^{4B}, T^{4A}, T^{5B}, T^{5C}$ are each independently for each occurrence absent, CO, NH, O, S, OC(O), NHC(O), $CH_2$, $CH_2NH$ or $CH_2O$;

$Q^{2A}, Q^{2B}, Q^{3A}, Q^{3B}, Q^{4A}, Q^{4B}, Q^{5A}, Q^{5B}, R^{5C}$ are independently for each occurrence absent, alkylene, substituted alkylene wherein one or more methylenes can be interrupted or terminated by one or more of O, S, S(O), $SO_2$, N(R N), C(R')=C(R"), CEC or C(O);

$R^{2A}, R^{2B}, R^{3A}, R^{3B}, R^{4A}, R^{4B}, R^{5A}, R^{5B}, R^{5C}$ are each independently for each occurrence absent, NH, O, S, $CH_2$, C(O)O, C(O)NH, NHCH($R^a$)C(O), —C(O)—CH($R^a$)—NH—, CO, CH=N—O,

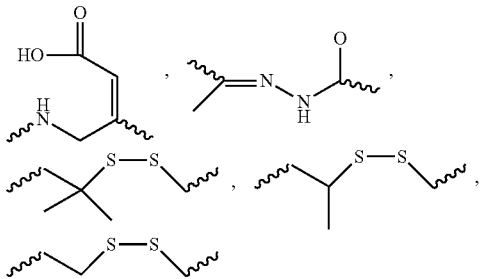

or heterocyclyl; $L^{2A}, L^{2B}, L^{3A}, L^{3B}, L^{4A}, L^{4B}, L^{5A}, L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XLIX):

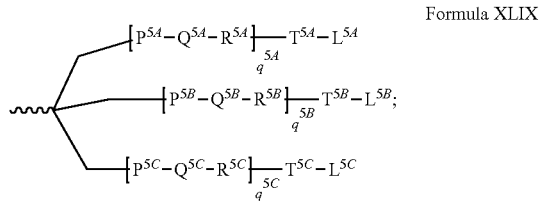

Formula XLIX wherein $L^{5A}, L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. Patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941; 6,294,664; 6,320,017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, such as, dsRNAi agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.,* 2007, 365(1):54-61; Letsinger et al., *Proc. Natl. Acad. Sci. USA,* 1989, 86:6553), cholic acid (Manoharan et al., *Bioorg. Med. Chem. Lett.,* 1994, 4:1053), a thioether, e.g., hexyl-S-tritylthiol (Manoharan et al., *Ann. N.Y. Acad. Sci.,* 1992, 660:306; Manoharan et al., *Bioorg. Med. Chem. Let.,* 1993, 3:2765), a thiocholesterol (Oberhauser et al., *Nucl. Acids Res.,* 1992, 20:533), an aliphatic chain, e.g., dodecandiol or undecyl residues (Saison-Behmoaras et al., *EMBO J.,* 1991, 10:111; Kabanov et al., *FEBS Lett.,* 1990, 259:327; Svinarchuk et al., *Biochimie,* 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.,* 1995, 36:3651; Shea et al., *Nucl. Acids Res.,* 1990, 18:3777), a polyamine or a polyethylene glycol chain (Manoharan et al., *Nucleosides & Nucleotides,* 1995, 14:969), or adamantane acetic acid (Manoharan et al., *Tetrahedron Lett.,* 1995, 36:3651), a palmityl moiety (Mishra et al., *Biochim. Biophys. Acta,* 1995, 1264:229), or an octadecylamine or hexylamino-carbonyl-oxycholesterol moiety (Crooke et al., *J. Pharmacol. Exp. Ther.,* 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject susceptible to or diagnosed with a TTR-associated disorder, e.g., senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602). Modification of the RNA or the pharmaceutical carrier can also permit targeting of the iRNA to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178).

In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H, et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R, et al (2003) *J. Mol. Biol* 327:761-766; Verma, U N, et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N, et al (2003), supra), "solid nucleic acid lipid particles" (Zimmermann, T S, et al (2006) *Nature* 441:111-114), cardiolipin (Chien, P Y, et al (2005) *Cancer Gene Ther.* 12:321-328; Pal, A, et al (2005) *Intl. Oncol.* 26:1087-1091), polyethyleneimine (Bonnet M E, et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A, et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety. Certain aspects of the instant disclosure relate to a method of reducing the expression of an TTR gene in a cell, comprising contacting said cell with the double-stranded RNAi agent of the disclosure. In one embodiment, the cell is a hepatic cell, optionally a hepatocyte. In one embodiment, the cell is an extrahepatic cell.

A. Vector Encoded iRNAs of the Invention iRNA targeting the TTR gene can be expressed from transcription units inserted into DNA or RNA vectors (see, e.g., Couture, A, et al., *TIG.* (1996), 12:5-10; Skillern, A, et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for preventing or treating an TTR-associated disorder, e.g., senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, and hyperthyroxinemia.

Such pharmaceutical compositions are formulated based on the mode of delivery. One example is compositions that are formulated for systemic administration via parenteral delivery, e.g., by subcutaneous (SC), intramuscular (IM), or intravenous (IV) delivery. The pharmaceutical compositions of the invention may be administered in dosages sufficient to inhibit expression of an TTR gene.

In some embodiments, the pharmaceutical compositions of the invention are sterile. In another embodiment, the pharmaceutical compositions of the invention are pyrogen free.

The pharmaceutical compositions of the invention may be administered in dosages sufficient to inhibit expression of an TTR gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, such as, about 0.3 mg/kg and about 3.0 mg/kg. A repeat-dose regimen may include administration of a therapeutic amount of iRNA on a regular basis, such as every month, once every 3-6 months, or once a year. In certain embodiments, the iRNA is administered about once per month to about once per six months.

After an initial treatment regimen, the treatments can be administered on a less frequent basis. Duration of treatment can be determined based on the severity of disease.

In other embodiments, a single dose of the pharmaceutical compositions can be long lasting, such that doses are administered at not more than 1, 2, 3, or 4 month intervals. In some embodiments of the invention, a single dose of the pharmaceutical compositions of the invention is administered about once per month. In other embodiments of the invention, a single dose of the pharmaceutical compositions of the invention is administered quarterly (i.e., about every three months). In other embodiments of the invention, a single dose of the pharmaceutical compositions of the invention is administered twice per year (i.e., about once every six months).

The skilled artisan will appreciate that certain factors can influence the dosage and timing required to effectively treat a subject, including but not limited to mutations present in the subject, previous treatments, the general health or age of the subject, and other diseases present. Moreover, treatment of a subject with a prophylactically or therapeutically effective amount, as appropriate, of a composition can include a single treatment or a series of treatments.

The pharmaceutical compositions of the present disclosure can be administered in a number of ways depending upon whether local or systemic treatment is desired and upon the area to be treated. Administration may be topical (including ophthalmic, vaginal, rectal, intranasal, transdermal), oral, or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular tissue, such as the liver.

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the RNAi agents featured in the disclosure are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). RNAi agents featured in the disclosure can be encapsulated within liposomes or can form complexes thereto, in particular to cationic liposomes. Alternatively, RNAi agents can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a C1-20 alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

In one embodiment, the siRNAs, double stranded RNA agents of the invention, are administered to a cell in a pharmaceutical composition by a topical route of administration. In one embodiment, the pharmaceutical composition may include an siRNA compound mixed with a topical delivery agent. The topical delivery agent can be a plurality of microscopic vesicles. The microscopic vesicles can be liposomes. In some embodiments the liposomes are cationic liposomes.

In another embodiment, the dsRNA agent is admixed with a topical penetration enhancer. In one embodiment, the topical penetration enhancer is a fatty acid. The fatty acid can be arachidonic acid, oleic acid, lauric acid, caprylic acid, capric acid, myristic acid, palmitic acid, stearic acid, linoleic acid, linolenic acid, dicaprate, tricaprate, monolein, dilaurin, glyceryl 1-monocaprate, 1-dodecylazacycloheptan-2-one, an acylcarnitine, an acylcholine, or a C1-10 alkyl ester, monoglyceride, diglyceride or pharmaceutically acceptable salt thereof.

In another embodiment, the topical penetration enhancer is a bile salt. The bile salt can be cholic acid, dehydrocholic acid, deoxycholic acid, glucholic acid, glycholic acid, glycodeoxycholic acid, taurocholic acid, taurodeoxycholic acid, chenodeoxycholic acid, ursodeoxycholic acid, sodium tauro-24,25-dihydro-fusidate, sodium glycodihydrofusidate, polyoxyethylene-9-lauryl ether or a pharmaceutically acceptable salt thereof.

In another embodiment, the penetration enhancer is a chelating agent. The chelating agent can be EDTA, citric acid, a salicyclate, a N-acyl derivative of collagen, laureth-9, an N-amino acyl derivative of a beta-diketone or a mixture thereof.

In another embodiment, the penetration enhancer is a surfactant, e.g., an ionic or nonionic surfactant. The surfactant can be sodium lauryl sulfate, polyoxyethylene-9-lauryl ether, polyoxyethylene-20-cetyl ether, a perfluorchemical emulsion or mixture thereof.

In another embodiment, the penetration enhancer can be selected from a group consisting of unsaturated cyclic ureas, 1-alkyl-alkones, 1-alkenylazacyclo-alakanones, steroidal anti-inflammatory agents and mixtures thereof. In yet another embodiment the penetration enhancer can be a glycol, a pyrrol, an azone, or a terpenes.

In one aspect, the invention features a pharmaceutical composition including an siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof) in an injectable dosage form. In one embodiment, the injectable dosage form of the pharmaceutical composition includes sterile aqueous solutions or dispersions and sterile powders. In some embodiments the sterile solution can include a diluent such as water; saline solution; fixed oils, polyethylene glycols, glycerin, or propylene glycol.

The iRNA molecules of the invention can be incorporated into pharmaceutical compositions. Such compositions typically include one or more species of iRNA and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration to a cell, e.g., a liver cell. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

Pharmaceutical compositions of the present invention include, but are not limited to, solutions, emulsions, and liposome-containing formulations. These compositions can be generated from a variety of components that include, but are not limited to, preformed liquids, self-emulsifying solids, and self-emulsifying semisolids. Formulations include those that target the liver.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers.

A. Additional Formulations i. Emulsions

The compositions of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, LV., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution either in the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, LV., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, LV., Popovich N G., and Ansel H C., 2004, Lippincott Williams & Wilkins (8th ed.), New York, NY; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic, and amphoteric (see e.g., Ansel's Pharmaceutical Dosage Forms and Drug Delivery Systems, Allen, LV., Popovich N G., and Ansel H C., 2004, Lippincott Williams & Wilkins (8th ed.), New York, NY Rieger, in Pharmaceutical Dosage Forms, Lieberman, Rieger and Banker (Eds.), 1988, Marcel Dekker, Inc., New York, N.Y., volume 1, p. 285).

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives, and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

The application of emulsion formulations via dermatological, oral, and parenteral routes, and methods for their manufacture have been reviewed in the literature (see e.g., Ansel's Pharmaceutical Dosage Forms and Drug Delivery Systems, Allen, LV., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

ii. Microemulsions

In one embodiment of the present invention, the compositions of iRNAs and nucleic acids are formulated as microemulsions. A microemulsion can be defined as a system of water, oil, and amphiphile which is a single optically isotropic and thermodynamically stable liquid solution (see e.g., Ansel's Pharmaceutical Dosage Forms and Drug Delivery Systems, Allen, LV., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215).

iii. Microparticles

An iRNA of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, NY, 2002; Lee et al., Critical Reviews in Therapeutic Drug Carrier Systems, 1991, p.92). Each of the above mentioned classes of penetration enhancers and their use in manufacture of pharmaceutical compositions and delivery of pharmaceutical agents are well known in the art.

v. Excipients

In contrast to a carrier compound, a "pharmaceutical carrier" or "excipient" is a pharmaceutically acceptable solvent, suspending agent, or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Such agent are well known in the art.

vi. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings, or aromatic substances, and the like which do not deleteriously interact with the nucleic acid(s) of the formulation.

Aqueous suspensions can contain substances which increase the viscosity of the suspension including, for example, sodium carboxymethylcellulose, sorbitol, or dextran. The suspension can also contain stabilizers.

In some embodiments, pharmaceutical compositions featured in the invention include (a) one or more iRNA and (b) one or more agents which function by a non-iRNA mechanism and which are useful in treating an TTR-associated disorder, e.g., senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease.

Toxicity and prophylactic efficacy of such compounds can be determined by standard pharmaceutical procedures in cell cultures or experimental animals, e.g., for determining the LD50 (the dose lethal to 50% of the population) and the ED50 (the dose prophylactically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50, such as, an ED80 or ED90, with little or no toxicity. The dosage can vary within this range depending upon the dosage form employed and the route of administration utilized. For any compound used in the methods featured in the invention, the prophylactically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) or higher levels of inhibition as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents used for the prevention or treatment of an TTR-associated disorder, e.g., senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, and hyperthyroxinemia. In any event, the administering physician can adjust the amount and timing of iRNA administration on the basis of results observed using standard measures of efficacy known in the art or described herein.

VI. Methods for Inhibiting TTR Expression

The present invention also provides methods of inhibiting expression of an TTR gene in a cell. The methods include contacting a cell with an RNAi agent, e.g., double stranded RNA agent, in an amount effective to inhibit expression of TTR in the cell, thereby inhibiting expression of TTR in the cell. In some embodiments of the disclosure, expression of an TTR gene is inhibited preferentially in the liver (e.g., hepatocytes).

Contacting of a cell with an iRNA, e.g., a double stranded RNA agent, may be done in vitro or in vivo. Contacting a cell in vivo with the iRNA includes contacting a cell or group of cells within a subject, e.g., a human subject, with the iRNA. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In some embodiments, the targeting ligand is a carbohydrate moiety, e.g., a GalNAc$_3$ ligand, or any other ligand that directs the RNAi agent to a site of interest.

The term "inhibiting," as used herein, is used interchangeably with "reducing," "silencing," "downregulating", "suppressing", and other similar terms, and includes any level of inhibition.

The phrase "inhibiting expression of an TTR" is intended to refer to inhibition of expression of any TTR gene (such as, e.g., a mouse TTR gene, a rat TTR gene, a monkey TTR gene, or a human TTR gene) as well as variants or mutants of an TTR gene. Thus, the TTR gene may be a wild-type TTR gene, a mutant TTR gene, or a transgenic TTR gene in the context of a genetically manipulated cell, group of cells, or organism.

"Inhibiting expression of an TTR gene" includes any level of inhibition of an TTR gene, e.g., at least partial suppression of the expression of an TTR gene. The expression of the TTR gene may be assessed based on the level, or the change in the level, of any variable associated with TTR gene expression, e.g., TTR mRNA level or TTR protein level. This level may be assessed in an individual cell or in a group of cells, including, for example, a sample derived from a subject.

Inhibition may be assessed by a decrease in an absolute or relative level of one or more variables that are associated with TTR expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of an TTR gene is inhibited by at least 50%, 55%, 60%, 65%, 70%, 75%, 80%, 85%, 90%, or 95%, or to below the level of detection of the assay. In some embodiments, expression of an TTR gene is inhibited by at least 70%. It is further understood that inhibition of TTR expression in certain tissues, e.g., in liver, without a significant inhibition of expression in other tissues, e.g., brain, may be desirable. In some embodiments, expression level is determined using the assay method provided in Example 2 with a 10 nM siRNA concentration in the appropriate species matched cell line.

In certain embodiments, inhibition of expression in vivo is determined by knockdown of the human gene in a rodent expressing the human gene, e.g., an AAV-infected mouse expressing the human target gene (i.e., TTR), e.g., when administered as a single dose, e.g., at 3 mg/kg at the nadir of RNA expression. Knockdown of expression of an endogenous gene in a model animal system can also be determined, e.g., after administration of a single dose at, e.g., 3 mg/kg at the nadir of RNA expression. Such systems are useful when the nucleic acid sequence of the human gene and the model animal gene are sufficiently close such that the human iRNA provides effective knockdown of the model animal gene. RNA expression in liver is determined using the PCR methods provided in Example 2.

Inhibition of the expression of an TTR gene may be manifested by a reduction of the amount of mRNA expressed by a first cell or group of cells (such cells may be present, for example, in a sample derived from a subject) in which an TTR gene is transcribed and which has or have been treated (e.g., by contacting the cell or cells with an iRNA of the invention, or by administering an iRNA of the invention to a subject in which the cells are or were present) such that the expression of an TTR gene is inhibited, as compared to a second cell or group of cells substantially identical to the first cell or group of cells but which has not or have not been so treated (control cell(s) not treated with an iRNA or not treated with an iRNA targeted to the gene of interest). In some embodiments, the inhibition is assessed by the method provided in Example 2 using a 10 nM siRNA concentration in the species matched cell line and expressing the level of mRNA in treated cells as a percentage of the level of mRNA in control cells, using the following formula:

$$\frac{(\text{mRNA in control cells}) - (\text{mRNA in treated cells})}{(\text{mRNA in control cells})} \cdot 100\%$$

In other embodiments, inhibition of the expression of an TTR gene may be assessed in terms of a reduction of a parameter that is functionally linked to TTR gene expression, e.g., TTR protein level in blood or serum from a subject. TTR gene silencing may be determined in any cell expressing TTR, either endogenous or heterologous from an expression construct, and by any assay known in the art.

Inhibition of the expression of an TTR protein may be manifested by a reduction in the level of the TTR protein that is expressed by a cell or group of cells or in a subject sample (e.g., the level of protein in a blood sample derived from a subject). As explained above, for the assessment of mRNA suppression, the inhibition of protein expression levels in a treated cell or group of cells may similarly be expressed as a percentage of the level of protein in a control cell or group of cells, or the change in the level of protein in a subject sample, e.g., blood or serum derived therefrom.

A control cell, a group of cells, or subject sample that may be used to assess the inhibition of the expression of an TTR gene includes a cell, group of cells, or subject sample that has not yet been contacted with an RNAi agent of the invention. For example, the control cell, group of cells, or subject sample may be derived from an individual subject (e.g., a human or animal subject) prior to treatment of the subject with an RNAi agent or an appropriately matched population control.

The level of TTR mRNA that is expressed by a cell or group of cells may be determined using any method known in the art for assessing mRNA expression. In one embodiment, the level of expression of TTR in a sample is determined by detecting a transcribed polynucleotide, or portion thereof, e.g., mRNA of the TTR gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene™ (PreAnalytix™, Switzerland). Typical assay formats utilizing ribonucleic acid hybridization include nuclear run-on assays, RT-PCR, RNase protection assays, northern blotting, in situ hybridization, and microarray analysis.

In some embodiments, the level of expression of TTR is determined using a nucleic acid probe. The term "probe", as used herein, refers to any molecule that is capable of selectively binding to a specific TTR. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to TTR mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix® gene chip array. A skilled artisan can readily adapt known mRNA detection methods for use in determining the level of TTR mRNA.

An alternative method for determining the level of expression of TTR in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) Proc. Natl. Acad. Sci. USA 88:189-193), self sustained sequence replication (Guatelli et al. (1990) Proc. Natl. Acad. Sci. USA 87:1874-1878), transcriptional amplification system (Kwoh et al. (1989) Proc. Natl. Acad. Sci. USA 86:1173-1177), Q-Beta Replicase (Lizardi et al. (1988)Bio/Technology 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of TTR is determined by quantitative fluorogenic RT-PCR (i.e., the TaqMan™ System). In some embodiments, expression level is determined by the method provided in Example 2 using, e.g., a 10 nM siRNA concentration, in the species matched cell line.

The expression levels of TTR mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of TTR expression level may also comprise using nucleic acid probes in solution.

In some embodiments, the level of mRNA expression is assessed using branched DNA (bDNA) assays or real time PCR (qPCR). The use of these methods is described and exemplified in the Examples presented herein. In some embodiments, expression level is determined by the method provided in Example 2 using a 10 nM siRNA concentration in the species matched cell line.

The level of TTR protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like.

In some embodiments, the efficacy of the methods of the invention are assessed by a decrease in TTR mRNA or protein level (e.g., in a liver biopsy).

In some embodiments, the efficacy of the methods of the invention can be monitored by detecting or monitoring a reduction in a symptom of an TTR-associate disorder, e.g., reduction in sensory neuropathy (e.g., paresthesia, hypesthesia in distal limbs), autonomic neuropathy (e.g., gastrointestinal dysfunction, such as gastric ulcer, or orthostatic hypotension), motor neuropathy, seizures, dementia, myelopathy, polyneuropathy, carpal tunnel syndrome, autonomic insufficiency, cardiomyopathy, vitreous opacities, renal insufficiency, nephropathy, substantially reduced mBMI (modified Body Mass Index), cranial nerve dysfunction, and corneal lattice dystrophy. It is well within the ability of one skilled in the art to monitor efficacy of the methods by measuring any one of such parameters, or any combination of parameters.

In some embodiments of the methods of the invention, the iRNA is administered to a subject such that the iRNA is delivered to a specific site within the subject. The inhibition of expression of TTR may be assessed using measurements of the level or change in the level of TTR mRNA or TTR protein in a sample derived from fluid or tissue from the specific site within the subject (e.g., liver or blood).

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

VII. Prophylactic and Treatment Methods of the Invention

The present invention also provides methods of using an iRNA of the invention or a composition containing an iRNA of the invention to inhibit expression of TTR, thereby preventing or treating an TTR-associated disorder, e.g., senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease. In the methods of the invention the cell may be contacted with the siRNA in vitro or in vivo, i.e., the cell may be within a subject.

A cell suitable for treatment using the methods of the invention may be any cell that expresses an TTR gene, e.g., a liver cell. A cell suitable for use in the methods of the invention may be a mammalian cell, e.g., a primate cell (such as a human cell, including human cell in a chimeric non-human animal, or a non-human primate cell, e.g., a monkey cell or a chimpanzee cell), or a non-primate cell. In certain embodiments, the cell is a human cell, e.g., a human liver cell. In the methods of the invention, TTR expression is inhibited in the cell by at least 50, 55, 60, 65, 70, 75, 80, 85, 90, or 95, or to a level below the level of detection of the assay.

The in vivo methods of the invention may include administering to a subject a composition containing an iRNA, where the iRNA includes a nucleotide sequence that is complementary to at least a part of an RNA transcript of the TTR gene of the mammal to which the RNAi agent is to be administered. The composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, intraocular (e.g., periocular, conjunctival, subtenon, intracameral, intravitreal, intraocular, anterior or posterior juxtascleral, subretinal, subconjunctival, retrobulbar, or intracanalicular injection), intravenous, intramuscular, subcutaneous, transdermal, airway (aerosol), and topical (including buccal and sublingual) administration.

In certain embodiments, the compositions are administered by intravenous infusion or injection. In certain embodiments, the compositions are administered by subcutaneous injection. In certain embodiments, the compositions are administered by intramuscular injection.

The mode of administration may be chosen based upon whether local or systemic treatment is desired and based upon the area to be treated. The route and site of administration may be chosen to enhance targeting.

In one aspect, the present invention also provides methods for inhibiting the expression of an TTR gene in a mammal. The methods include administering to the mammal a composition comprising a dsRNA that targets an TTR gene in a cell of the mammal and maintaining the mammal for a time sufficient to obtain degradation of the mRNA transcript of the TTR gene, thereby inhibiting expression of the TTR gene in the cell. Reduction in gene expression can be assessed by any methods known in the art and by methods, e.g. qRT-PCR, described herein, e.g., in Example 2. Reduction in protein production can be assessed by any methods known it the art, e.g. ELISA. In certain embodiments, a puncture liver biopsy sample serves as the tissue material for monitoring the reduction in the TTR gene or protein expression. In other embodiments, a blood sample serves as the subject sample for monitoring the reduction in the TTR protein expression.

The present invention further provides methods of treatment in a subject in need thereof, e.g., a subject diagnosed with an TTR-associated disorder, such as senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease.

The present invention further provides methods of prophylaxis in a subject in need thereof. The treatment methods of the invention include administering an iRNA of the invention to a subject, e.g., a subject that would benefit from a reduction of TTR expression, in a prophylactically effective amount of a dsRNA targeting an TTR gene or a pharmaceutical composition comprising a dsRNA targeting an TTR gene.

In one aspect, the present invention provides methods of treating a subject having a disorder that would benefit from reduction in TTR expression, e.g., an TTR-associated disorder, such as senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease.

Treatment of a subject that would benefit from a reduction and/or inhibition of TTR gene expression includes therapeutic treatment (e.g., a subject is having an TTR-associated disorder) and prophylactic treatment (e.g., the subject is not having an TTR-associated disorder or a subject may be at risk of developing an TTR-associated disorder).

In some embodiments, the TTR-associated disorder is selected from the group consisting of senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease.

In one embodiment, the subject is suffering from familial amyloidotic cardiomyopathy (FAC). In another embodiment, the subject is suffering from FAC with a mixed phenotype, i.e., a subject having both cardiac and neurological impairments. In yet another embodiment, the subject is suffering from FAP with a mixed phenotype, i.e., a subject having both neurological and cardiac impairments. In one embodiment, the subject is suffering from FAP that has been treated with an orthotopic liver transplantation (OLT).

In another embodiment, the subject is suffering from senile systemic amyloidosis (SSA). In other embodiments of the methods of the invention, the subject is suffering from familial amyloidotic cardiomyopathy (FAC) and senile systemic amyloidosis (SSA). Normal-sequence TTR causes cardiac amyloidosis in people who are elderly and is termed senile systemic amyloidosis (SSA) (also called senile cardiac amyloidosis (SCA) or cardiac amyloidosis). SSA often is accompanied by microscopic deposits in many other organs. TTR mutations accelerate the process of TTR amyloid formation and are the most important risk factor for the development of clinically significant TTR amyloidosis (also called ATTR (amyloidosis-transthyretin type)). More than 85 amyloidogenic TTR variants are known to cause systemic familial amyloidosis.

In some embodiments of the methods of the invention, the subject is suffering from transthyretin (TTR)-related familial amyloidotic polyneuropathy (FAP). Such subjects may suffer from ocular manifestations, such as vitreous opacity and glaucoma. It is known to one of skill in the art that amyloidogenic transthyretin (ATTR) synthesized by retinal pigment epithelium (RPE) plays important roles in the progression of ocular amyloidosis. Previous studies have shown that panretinal laser photocoagulation, which reduced the RPE cells, prevented the progression of amyloid deposition in the vitreous, indicating that the effective suppression of ATTR expression in RPE may become a novel therapy for ocular amyloidosis (see, e.g., Kawaji, T., et al., *Ophthalmology.* (2010) 117: 552-555). Another TTR-associated disease is hyperthyroxinemia, also known as "dystransthyretinemic hyperthyroxinemia" or "dysprealbuminemic hyperthyroxinemia". This type of hyperthyroxinemia may be secondary to an increased association of thyroxine with TTR due to a mutant TTR molecule with increased affinity for thyroxine. See, e.g., Moses et al. (1982) *J. Clin. Invest.,* 86, 2025-2033.

In some embodiments, the TTR-associated disorder is an ocular disease, e.g., Stargardt's disease, diabetic retinopathy, age-related macular degeneration (AMD), e.g., dry AMD and wet AMD, iris coloboma, comedogenic acne syndrome, microphthalmia, basal laminar drusen, diabetic macular edema, or retinal vein occlusion. In some embodiments, the RBP4-associate disorder is a metabolic disorder, e.g., a disorder of glucose and lipid homeostasis, e.g., insulin resistance associated with type II diabetes, or a cardiovascular disease.

As used herein, the term "Stargardt's Disease" refers to a genetic eye disorder that causes retinal degeneration and vision loss. Stargardt's disease is a form of macular degeneration, and is also called "juvenile macular degeneration" or "Stargardt macular degeneration." Stargardt Disease is the most common form of inherited macular degeneration, affecting about 30,000 people in the U.S. The progressive vision loss associated with Stargardt disease is caused by the degeneration of photoreceptor cells in the central portion of the retina called the macula. The macula is responsible for sharp central vision, which is needed for detailed tasks such as reading, driving, and recognizing faces. In most people with Stargardt's Disease, a fatty yellow pigment (lipofuscin) builds up in cells underlying the macula. Over time, the abnormal accumulation of this substance can damage cells that are critical for clear central vision. In addition to central vision loss, people with Stargardt's Disease have problems with night vision that can make it difficult to navigate in low light. Some affected individuals also have impaired color vision. The signs and symptoms of Stargardt's Disease typically appear in late childhood to early adulthood and worsen over time.

Increased synthesis and excessive accumulation of cytotoxic lipofuscin, e.g., lipid-protein-retinoid aggregates, in the RPE was shown in a mouse model of Stargardt's disease ($Abca4^{-/-}$). The major cytotoxic component of RPE lipofuscin is bisretinoid. Lipofuscin synthesis in the retina depends on the influx of serum retinol from the circulation into the RPE, and formation of the tertiary RBP4/TTR/retinol complex in the serum is required for this influx. As shown by Racz et al, administering a non-retinoid RBP4 antagonist to $Abca4^{-/-}$ mice significantly reduced serum RBP4 levels and inhibited bisretinoid synthesis (Racz et al. *J Biol Chem.* 2018, 20; 293(29):11574-11588), which represents a potential treatment strategy for Stargardt's disease and other disorders characterized by excessive accumulation of lipofuscin.

As used herein, the term "age-related macular degeneration" ("AMD") or "macular degeneration" refers to a progressive degeneration of the macular, the central part of the retina, in people over 55 years of age. AMD accounts for 8.7% of all blindness worldwide. AMD is characterized by large drusen deposits (deposits containing lipids and proteins) under the retina. When AMD damages the macula, the center part of a person's vision may become blurred or wavy, and a blind spot may develop. AMD can cause vision loss quickly or slowly, and can make it very hard to do things that require sharp vision, such as reading, sewing, cooking or driving; it can also make it difficult to see in dim light. There are two types of AMD, referred to as wet AMD and dry AMD.

Macular degeneration is initiated and perpetuated by the accumulation of toxic vitamin A derivatives in the retinal pigment epithelium (RPE). Pharmacological inhibition of vitamin A delivery or metabolism in the RPE can significantly slow and reduce vision loss in animal models of macular degeneration. Inhibitory peptides that block interaction between RBP4 and its receptor, STRA6, were shown to reduce vitamin A delivery to RPE, and could serve as the basis for the development of a therapeutic to treat macular degeneration (Farjo, et al., 2013, *ARVO Annual Meeting,* 54(15), 1702).

"Wet AMD," also called "neovascular AMD" or "wet macular degeneration" is characterized by pathological blood vessel growth from the choroid into the retina (choroidal neovascularization), driven largely by excessive vascular endothelial growth factor (VEGF) production by the retinal pigment epithelium (RPE).

"Dry AMD," also called "geographic atrophy" or "dry macular degeneration" is caused by RPE cell death and photoreceptor degeneration, leading to vision loss.

As used herein, the term "diabetic retinopathy" ("DR") refers to an eye condition that can cause vision loss and blindness in people who have diabetes. It's caused by damage to the blood vessels of the light-sensitive tissue at the back of the eye (retina). At first, diabetic retinopathy may cause no symptoms or only mild vision problems. Eventually, it can cause blindness. Despite intensive glycemic control, 80% of Type 2 diabetes patients will progress to DR within 15 years of disease onset. In addition, diabetic retinopathy develops in 70-100% of individuals with Type 1 diabetes. In early stages, patients may present with microaneurysm, hard exudates, hemorrhages and cotton-wool spots in the fundus. As the disease progress, new blood vessels may grow due to ischemia but they are fragile, can cause hemorrhage and ultimately destroy the retina. The management of DR revolves around panretinal laser photocoagulation for proliferative disease while diabetic macular edema is treated by focal or a grid laser treatment and intraocular anti-VEGF agents and steroids. Current DR therapies are associated with inconvenient delivery (laser surgery, frequent intraocular injections) and unpleasant side-effects (steroid-induced glaucoma and cataract). Recent studies have shown that RBP4 plasma levels were associated with diabetic retinopathy in pateints with type 2 diabetes, and patients in a higher level of RBP4 had a greater risk of developing diabetic retinopathy (Li et al., *Biosci Rep.* 2018 Oct. 31; 38 (5): BSR20181100), suggesting a possible role of RBP4 in the pathogenesis of DR complications.

As used herein, the term "diabetic macular edema" ("DME") refers to a form of diabetic retinopathy (DR), where the diseased vessels in the retina leak fluid from the circulation into the macula, leading to severe vision loss.

As used herein, the term "basal laminal drusen" ("BLD"), also called "cuticular drusen" or "early adult onset, grouped drusen", refers to a condition in which small drusen randomly deposit in the macula. In late stages, these drusen become more numerous and scatter throughout the retina, which may ultimately lead to a serious pigment epithelial detachment of the macula and result in vision loss. The drusen deposits are often autofluorescent.

As used herein, the term "retinal vein occlusion" ("RVO") refers to a blockage of the small veins that carry blood away from the retina, which is subdivided into central and branch RVO. Central RVO is caused by impaired outflow from the central retinal vein, while branch RVO arises when a branch of the central vein is occluded. Due to the occlusion, the retina is likely to develop ischemia, resulting in increase in VEGF and inflammatory proteins, which may drive the development of macular edema, neovascularization, glaucoma and ultimately blindness if untreated. The occlusion in RVO cannot be treated, but complications can be managed by methods such as focal laser treatment for macular edema or anti-VEGF for neovascularization.

A "TTR-associated ocular disorder" includes any ocular disease associated with the TTR and/or RBP4 gene or protein in the eye that would benefit from reduction in TTR expression. Such TTR-associated ocular diseases are characterized by, for example, accumulation of lipofuscin pigment (Stargardt's disease), deposits of byproducts of ocular cell metabolism termed drusen in the macula (AMD and BLD) or neovascularization in the choroid or retina (AMD, DR, DME, RVO) which accumulate and lead to obstruction of light transmission, tissue damage, and visual dysfunction or loss.

Additional symptoms for an TTR-associated ocular disease include, for example, difficulty seeing in the center of the vision, which is needed for reading, sewing, cooking, looking at faces, and driving, trouble seeing in dim light, detecting small blind spots, blurred and distorted vision, decreased dark adaption, light sensitivity, poor color vision, or floating spots or dark strings. Further details regarding signs and symptoms of the various diseases or conditions are provided herein and are well known in the art.

In addition to ocular diseases, TTR is further implicated in a variety of human metabolic disorders, such as disorders of glucose and lipid homeostasis and cardiovascular diseases.

As used herein, a "metabolic disorder" refers to any disease or disorder that disrupts normal metabolism, the process of converting food to energy on a cellular level. Metabolic disorders affect the ability of the cell to perform critical biochemical reactions that involve the processing or transport of proteins (amino acids), carbohydrates (sugars and starches), or lipids (fatty acids). In some embodiments, an RBP4-associated disorder is a metabolic disorder, e.g., a disorder of glucose and lipid homeostasis, or a cardiovascular disease.

As used herein, a "disorder of glucose and lipid homeostasis" refers to any disease or disorder that disrupts normal glucose and/or lipid metabolism. Examples of disorders of glucose and lipid homeostasis include, but are not limited to, diabetes, type I diabetes, type II diabetes, galactosemia, hereditary fructose intolerance, fructose 1,6-diphosphatase deficiency, glycogen storage disorders, congenital disorders of glycosylation, insulin resistance, insulin insufficiency, hyperinsulinemia, impaired glucose tolerance (IGT), atherosclerosis, dyslipidemia, hypertriglyceridemia (including drug-induced hypertriglyceridemia, diuretic-induced hypertriglyceridemia, alcohol-induced hypertriglyceridemia, β-adrenergic blocking agent-induced hypertriglyceridemia, estrogen-induced hypertriglyceridemia, glucocorticoid-induced hypertriglyceridemia, retinoid-induced hypertriglyceridemia, cimetidine-induced hypertriglyceridemia, and familial hypertriglyceridemia), acute pancreatitis associated with hypertriglyceridemia, chylomicron syndrom, familial chylomicronemia, Apo-E deficiency or resistance, LPL deficiency or hypoactivity, hyperlipidemia (including familial combined hyperlipidemia), hypercholesterolemia, gout associated with hypercholesterolemia, xanthomatosis (subcutaneous cholesterol deposits), hyperlipidemia with heterogeneous LPL deficiency, hyperlipidemia with high LDL and heterogeneous LPL deficiency, fatty liver disease, or non-alcoholic steatohepatitis (NASH).

As used herein, the term "diabetes" refers to a group of metabolic diseases characterized by high blood sugar (glucose) levels which result from defects in insulin secretion or action, or both. There are two most common types of diabetes, namely type 1 diabetes and type 2 diabetes, which both result from the body's inability to regulate insulin. Insulin is a hormone released by the pancreas in response to increased levels of blood sugar (glucose) in the blood.

The term "type I diabetes," as used herein, refers to a chronic disease that occurs when the pancreas produces too little insulin to regulate blood sugar levels appropriately. Type I diabetes is also referred to as insulin-dependent diabetes mellitus, IDDM, and juvenile onset diabetes. People with type I diabetes (insulin-dependent diabetes) produce little or no insulin at all. Although about 6 percent of the United States population has some form of diabetes, only about 10 percent of all diabetics have type I disorder. Most people who have type I diabetes developed the disorder before age 30. Type 1 diabetes represents the result of a progressive autoimmune destruction of the pancreatic β-cells with subsequent insulin deficiency. More than 90 percent of the insulin-producing cells (beta cells) of the pancreas are permanently destroyed. The resulting insulin deficiency is severe, and to survive, a person with type I diabetes must regularly inject insulin.

In type II diabetes (also referred to as noninsulin-dependent diabetes mellitus, NDDM), the pancreas continues to manufacture insulin, sometimes even at higher than normal levels. However, the body develops insulin resistance and dysregulated insulin secretion. Type II diabetes may occur in children and adolescents but usually begins after age 30 and becomes progressively more common with age: about 15 percent of people over age 70 have type II diabetes. Obesity is a risk factor for type II diabetes, and 80 to 90 percent of the people with this disorder are obese. In some embodiments, diabetes includes pre-diabetes. "Pre-diabetes" refers to one or more early diabetic conditions including impaired glucose utilization, abnormal or impaired fasting glucose levels, impaired glucose tolerance, impaired insulin sensitivity and insulin resistance. Prediabetes is a major risk factor for the development of type 2 diabetes mellitus, cardiovascular disease and mortality. Much focus has been given to developing therapeutic interventions that prevent the development of type 2 diabetes by effectively treating prediabetes.

Diabetes can be diagnosed by the administration of a glucose tolerance test. Clinically, diabetes is often divided into several basic categories. Primary examples of these categories include, autoimmune diabetes mellitus, non-insulin-dependent diabetes mellitus (type 1 NDDM), insulin-dependent diabetes mellitus (type 2 IDDM), non-autoimmune diabetes mellitus, non-insulin-dependent diabetes mellitus (type 2 NIDDM), and maturity-onset diabetes of the young (MODY). A further category, often referred to as secondary, refers to diabetes brought about by some identifiable condition which causes or allows a diabetic syndrome to develop. Examples of secondary categories include, diabetes caused by pancreatic disease, hormonal abnormalities, drug- or chemical-induced diabetes, diabetes caused by insulin receptor abnormalities, diabetes associated with genetic syndromes, and diabetes of other causes. (see e.g., Harrison's (1996) 14th ed., New York, McGraw-Hill).

Cardiovascular diseases are also considered "metabolic disorders", as defined herein. These diseases may include coronary artery disease (also called ischemic heart disease), inflammation associated with coronary artery disease, restenosis, peripheral vascular diseases, and stroke.

Disorders related to body weight are also considered "metabolic disorders", as defined herein. Such disorders may include obesity, metabolic syndrome including independent components of metabolic syndrome (e.g., central obesity, FBG/pre-diabetes/diabetes, hypercholesterolemia, hypertriglyceridemia, and hypertension), hypothyroidism, uremia, and other conditions associated with weight gain (including rapid weight gain), weight loss, maintenance of weight loss, or risk of weight regain following weight loss.

In some embodiments, the RNAi agent is administered to a subject in an amount effective to inhibit TTR expression in a cell within the subject. The amount effective to inhibit TTR expression in a cell within a subject may be assessed using methods discussed above, including methods that involve assessment of the inhibition of TTR mRNA, TTR protein, or related variables, such as a reduction in the severity of a symptom of an TTR-associate disorder, e.g., reduction insensory neuropathy (e.g., paresthesia, hypesthesia in distal limbs), autonomic neuropathy (e.g., gastrointestinal dysfunction, such as gastric ulcer, or orthostatic hypotension), motor neuropathy, seizures, dementia, myelopathy, polyneuropathy, carpal tunnel syndrome, autonomic insufficiency, cardiomyopathy, vitreous opacities, renal insufficiency, nephropathy, substantially reduced mBMI (modified Body Mass Index), cranial nerve dysfunction, and corneal lattice dystrophy.

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from an inhibition of TTR gene expression are subjects susceptible to or diagnosed with an TTR-associated disorder, such as senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease. In an embodiment, the method includes administering a composition featured herein such that expression of the target ab TTR gene is decreased, such as for about 1, 2, 3, 4, 5, 6, 1-6, 1-3, or 3-6 months per dose. In certain embodiments, the composition is administered once every 3-6 months.

In one embodiment, the iRNAs useful for the methods and compositions featured herein specifically target RNAs (primary or processed) of the target TTR gene. Compositions and methods for inhibiting the expression of these genes using iRNAs can be prepared and performed as described herein.

Administration of the iRNA according to the methods of the invention may result prevention or treatment of an TTR-associated disorder, e.g., senile systemic amyloidosis (SSA), systemic familial amyloidosis, familial amyloidotic polyneuropathy (FAP), familial amyloidotic cardiomyopathy (FAC), leptomeningeal/Central Nervous System (CNS) amyloidosis, hyperthyroxinemia, an ocular disease, e.g., Stargardt's disease, diabetic retinopathy, age-related macular degeneration (AMD), e.g., dry AMD and wet AMD; a metabolic disorder, e.g., a disorder of glucose and lipid homeostasis, e.g., insulin resistance associated with type II diabetes, and a cardiovascular disease. Subjects can be administered a therapeutic amount of iRNA, such as about 0.01 mg/kg to about 200 mg/kg.

In one embodiment, the iRNA is administered subcutaneously, i.e., by subcutaneous injection. One or more injections may be used to deliver the desired dose of iRNA to a subject. The injections may be repeated over a period of time.

The administration may be repeated on a regular basis. In certain embodiments, after an initial treatment regimen, the treatments can be administered on a less frequent basis. A repeat-dose regimen may include administration of a therapeutic amount of iRNA on a regular basis, such as once per month to once a year. In certain embodiments, the iRNA is administered about once per month to about once every three months, or about once every three months to about once every six months.

The invention further provides methods and uses of an iRNA agent or a pharmaceutical composition thereof for treating a subject that would benefit from reduction and/or inhibition of TTR gene expression, e.g., a subject having an TTR-associated disorder, in combination with other pharmaceuticals and/or other therapeutic methods, e.g., with known pharmaceuticals and/or known therapeutic methods, such as, for example, those which are currently employed for treating these disorders.

Accordingly, in some aspects of the invention, the methods which include administration of an iRNA agent of the invention, further include administering to the subject one or more additional therapeutic agents. For example, in certain embodiments, an iRNA targeting TTR is administered in combination with, e.g., an agent useful in treating an TTR-associated disorder. Exemplary additional therapeutics and treatments for treating an TTR-associated disorder include, a TTR stabilizer and a non-steroidal anti-inflammatory agent (NSAIDS), e.g., diflunisal, and diuretics, and a combination of any of the foregoing.

A "therapeutic agent that stabilizes TTR" or "that stabilizes a TTR tetramer" is an agent that reduces or prevents the dissociation of the subunits of a TTR tetramer, e.g., into monomers. In some embodiments, the agent reduces the formation of TTR amyloid plaques, e.g., by reducing the level of TTR monomers or proteolytic fragments of TTR monomers that form TTR amyloid plaques. Such agents include, but are not limited to, tafamidis, diflunisal, and AG10.

The iRNA and additional therapeutic agents may be administered at the same time and/or in the same combination, e.g., parenterally, or the additional therapeutic agent can be administered as part of a separate composition or at separate times and/or by another method known in the art or described herein.

The iRNA agent and an additional therapeutic agent and/or treatment may be administered at the same time and/or in the same combination, e.g., parenterally, or the additional therapeutic agent can be administered as part of a separate composition or at separate times and/or by another method known in the art or described herein.

VIII. Kits

In certain aspects, the instant disclosure provides kits that include a suitable container containing a pharmaceutical formulation of a siRNA compound, e.g., a double-stranded siRNA compound, or siRNA compound, (e.g., a precursor, e.g., a larger siRNA compound which can be processed into a siRNA compound, or a DNA which encodes an siRNA compound, e.g., a double-stranded siRNA compound, or ssiRNA compound, or precursor thereof).

Such kits include one or more dsRNA agent(s) and instructions for use, e.g., instructions for administering a prophylactically or therapeutically effective amount of a dsRNA agent(s). The dsRNA agent may be in a vial or a pre-filled syringe. The kits may optionally further comprise means for administering the dsRNA agent (e.g., an injection device, such as a pre-filled syringe or auto-injector device), or means for measuring the inhibition of TTR (e.g., means for measuring the inhibition of TTR mRNA, TTR protein, and/or TTR activity). Such means for measuring the inhibition of TTR may comprise a means for obtaining a sample from a subject, such as, e.g., a plasma sample. The kits of the invention may optionally further comprise means for determining the therapeutically effective or prophylactically effective amount.

In certain embodiments the individual components of the pharmaceutical formulation may be provided in one container, e.g., a vial or a pre-filled syringe. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

This invention is further illustrated by the following examples which should not be construed as limiting. The entire contents of all references, patents and published patent applications cited throughout this application, as well as the informal Sequence Listing and Figures, are hereby incorporated herein by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

siRNA Design siRNAs targeting the 3'UTR of the human transthyretin (TTR) gene (human: NCBI refseqID NM_000371.4, NCBI GeneID: 7276) were designed using custom R and Python scripts. The human NM_000505.4 REFSEQ mRNA, has a length of 616 bases.

Detailed lists of the unmodified TTR sense and antisense strand nucleotide sequences are shown in Table 2. Detailed lists of the modified TTR sense and antisense strand nucleotide sequences are shown in Table 3.

It is to be understood that, throughout the application, a duplex name without a decimal is equivalent to a duplex name with a decimal which merely references the batch number of the duplex. For example, AD-959917 is equivalent to AD-959917.1.

siRNA Synthesis siRNAs were designed, synthesized, and prepared using methods known in the art.

Briefly, siRNA sequences were synthesized on a 1 µmol scale using a Mermade 192 synthesizer (BioAutomation) with phosphoramidite chemistry on solid supports. The solid support was controlled pore glass (500-1000 Å) loaded with a custom GalNAc ligand (3'-GalNAc conjugates), universal solid support (AM Chemicals), or the first nucleotide of interest. Ancillary synthesis reagents and standard 2-cyanoethyl phosphoramidite monomers (2'-deoxy-2'-fluoro, 2'-O-methyl, RNA, DNA) were obtained from Thermo-Fisher (Milwaukee, WI), Hongene (China), or Chemgenes (Wilmington, MA, USA). Additional phosphoramidite monomers were procured from commercial suppliers, prepared in-house, or procured using custom synthesis from various CMOs. Phosphoramidites were prepared at a concentration of 100 mM in either acetonitrile or 9:1 acetonitrile: DMF and were coupled using 5-Ethylthio-1H-tetrazole (ETT, 0.25 M in acetonitrile) with a reaction time of 400 s. Phosphorothioate linkages were generated using a 100 mM solution of 3-((Dimethylamino-methylidene) amino)-3H-1,2,4-dithiazole-3-thione (DDTT, obtained from Chemgenes (Wilmington, MA, USA)) in anhydrous acetonitrile/pyridine (9:1 v/v). Oxidation time was 5 minutes. All sequences were synthesized with final removal of the DMT group ("DMT-Off").

Upon completion of the solid phase synthesis, solid-supported oligoribonucleotides were treated with 300 µL of Methylamine (40% aqueous) at room temperature in 96 well plates for approximately 2 hours to afford cleavage from the solid support and subsequent removal of all additional base-labile protecting groups. For sequences containing any natural ribonucleotide linkages (2'-OH) protected with a tert-butyl dimethyl silyl (TBDMS) group, a second deprotection step was performed using TEA.3HF (triethylamine trihydrofluoride). To each oligonucleotide solution in aqueous methylamine was added 200 µL of dimethyl sulfoxide (DMSO) and 300 µL TEA.3HF and the solution was incubated for approximately 30 mins at 60° C. After incubation, the plate was allowed to come to room temperature and crude oligonucleotides were precipitated by the addition of 1 mL of 9:1 acetontrile:ethanol or 1:1 ethanol:isopropanol. The plates were then centrifuged at 4° C. for 45 mins and the supernatant carefully decanted with the aid of a multichannel pipette. The oligonucleotide pellet was resuspended in 20 mM NaOAc and subsequently desalted using a HiTrap size exclusion column (5 mL, GE Healthcare) on an Agilent LC system equipped with an autosampler, UV detector, conductivity meter, and fraction collector. Desalted samples were collected in 96 well plates and then analyzed by LC-MS and UV spectrometry to confirm identity and quantify the amount of material, respectively.

Duplexing of single strands was performed on a Tecan liquid handling robot. Sense and antisense single strands were combined in an equimolar ratio to a final concentration of 10 µM in 1× PBS in 96 well plates, the plate sealed, incubated at 100° C. for 10 minutes, and subsequently allowed to return slowly to room temperature over a period of 2-3 hours. The concentration and identity of each duplex was confirmed and then subsequently utilized for in vitro screening assays.

Example 2. In Vitro Screening Methods

Cell Culture and 384-Well Transfections

Hep3b cells (ATCC, Manassas, VA) are grown to near confluence at 37° C. in an atmosphere of 5% $CO_2$ in Eagle's Minimum Essential Medium (Gibco) supplemented with 10% FBS (ATCC) before being released from the plate by trypsinization. Transfection is carried out by adding 7.5 µl of Opti-MEM plus 0.1 µl of Lipofectamine RNAiMax per well (Invitrogen, Carlsbad CA. cat #13778-150) to 2.5 µl of each siRNA duplex to an individual well in a 384-well plate. The mixture is then incubated at room temperature for 15 minutes. Forty µl of complete growth media without antibiotic containing ~$1.5\times10^4$ cells are then added to the siRNA mixture. Cells are incubated for 24 hours prior to RNA purification. Single dose experiments are performed at 10 nM, 1 nM, and 0.1 nM final duplex concentration.

Total RNA Isolation Using DYNABEADS mRNA Isolation Kit (Invitrogen™, Part #: 610-12)

Cells are lysed in 75 µl of Lysis/Binding Buffer containing 3 µL of beads per well and mixed for 10 minutes on an electrostatic shaker. The washing steps are automated on a Biotek EL406, using a magnetic plate support. Beads are washed (in 904) once in Buffer A, once in Buffer B, and twice in Buffer E, with aspiration steps in between. Following a final aspiration, complete 10 µL RT mixture is added to each well, as described below.

cDNA Synthesis Using ABI High Capacity cDNA Reverse Transcription Kit (Applied Biosystems, Foster City, CA, Cat #4368813)

A master mix of 1 µl 10× Buffer, 0.4 µl 25× dNTPs, 1 µl Random primers, 0.5 µl Reverse Transcriptase, 0.5 µl RNase inhibitor and 6.6 µl of $H_2O$ per reaction are added per well. Plates are sealed, agitated for 10 minutes on an electrostatic shaker, and then incubated at 37 degrees C. for 2 hours. Following this, the plates are agitated at 80 degrees C. for 8 minutes.

Real Time PCR

Two microlitre (µl) of cDNA are added to a master mix containing 0.5 µl of human GAPDH TaqMan Probe (4326317E), 0.5 µl human TTR, 2 µl nuclease-free water and 5 µl Lightcycler 480 probe master mix (Roche Cat #04887301001) per well in a 384 well plates (Roche cat #04887301001). Real time PCR is done in a LightCycler480 Real Time PCR system (Roche).

To calculate relative fold change, data are analyzed using the ΔΔCt method and normalized to assays performed with cells transfected with 10 nM AD-1955, or mock transfected cells. $IC_{50}$s are calculated using a 4 parameter fit model using XLFit and normalized to cells transfected with AD-1955 or mock-transfected. The sense and antisense sequences of AD-1955 are: sense: cuuAcGcuGAGuAcuucGAdTsdT (SEQ ID NO:1383) and antisense UCGA-AGuACUcAGCGuAAGdTsdT (SEQ ID NO:1384).

The results of the single dose screens of the duplexes in Tables 2 and 3 in Cynomolgus hepatocytes cells are provided in Table 4.

TABLE 1

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
| --- | --- |
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
|---|---|
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3'- phosphorothioate |
| c | 2'-O-methylcytidine-3'-phosphate |
| cs | 2'-O-methylcytidine-3'- phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L10 | N-(cholesterylcarboxamidocaproyl)-4-hydroxyprolinol (Hyp-C6-Chol) |
| L96 | N-[tris(GalNAc-alkyl)-amidodecanoyl)]-4-hydroxyprolinol (Hyp-(GalNAc-alkyl)3) |

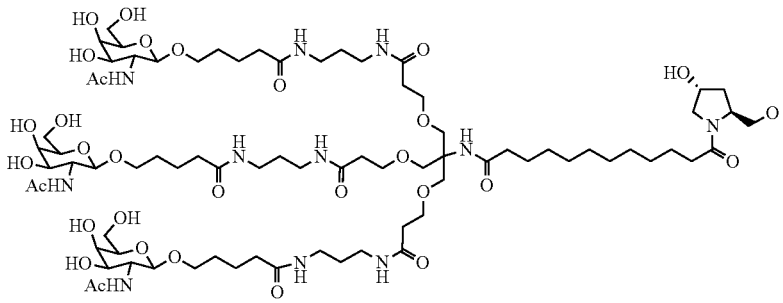

| Y34 | 2-hydroxymethyl-tetrahydrofurane-4-methoxy-3-phosphate (abasic 2'-OMe furanose) |
| Y44 | inverted abasic DNA (2-hydroxymethyl-tetrahydrofurane-5-phosphate) |
| (Agn) | Adenosine-glycol nucleic acid (GNA) |
| (Cgn) | Cytidine-glycol nucleic acid (GNA) |
| (Ggn) | Guanosine-glycol nucleic acid (GNA) |
| (Tgn) | Thymidine-glycol nucleic acid (GNA) S-Isomer |
| P | Phosphate |
| VP | Vinyl-phosphonate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythimidine-3'-phosphate |
| dTs | 2'-deoxythimidine-3'-phosphorothioate |
| dU | 2'-deoxyuridine |
| dUs | 2'-deoxyuridine-3'-phosphorothioate |
| (C2p) | cytidine-2'-phosphate |
| (G2p) | guanosine-2'-phosphate |
| (U2p) | uridine-2'-phosphate |

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
|---|---|
| (A2p) | adenosine-2'-phosphate |
| (Chd) | 2'-O-hexadecyl-cytidine-3'-phosphate |
| (Ahd) | 2'-O-hexadecyl-adenosine-3'-phosphate |
| (Ghd) | 2'-O-hexadecyl-guanosine-3'-phosphate |
| (Uhd) | 2'-O-hexadecyl-uridine-3'-phosphate |

TABLE 2

Unmodified Sense and Antisense Strand Sequences of TTR dsRNA Agents

| Duplex Name | Sense Sequence 5' to 3' | SEQ ID NO: | Antisense Sequence 5' to 3' | SEQ ID NO: | Range in NM_000371.4 |
|---|---|---|---|---|---|
| AD-649237 | CUGAAGGACGAGGGAUGGGAU | | AUCCCAUCCCUCGUCCUUCAGGU | | 600-622 |
| AD-649238 | UGAAGGACGAGGGAUGGGAUU | | AAUCCCAUCCCUCGUCCUUCAGG | | 601-623 |
| AD-649239 | GAAGGACGAGGGAUGGGAUUU | | AAAUCCCAUCCCUCGUCCUUCAG | | 602-624 |
| AD-649240 | AAGGACGAGGGAUGGGAUUUU | | AAAAUCCCAUCCCUCGUCCUUCA | | 603-625 |
| AD-649241 | AGGACGAGGGAUGGGAUUUCA | | UGAAAUCCCAUCCCUCGUCCUUC | | 604-626 |
| AD-649242 | GGACGAGGGAUGGGAUUUCAU | | AUGAAAUCCCAUCCCUCGUCCUU | | 605-627 |
| AD-649243 | GACGAGGGAUGGGAUUUCAUU | | AAUGAAAUCCCAUCCCUCGUCCU | | 606-628 |
| AD-649244 | ACGAGGGAUGGGAUUUCAUGU | | ACAUGAAAUCCCAUCCCUCGUCC | | 607-629 |
| AD-649245 | CGAGGGAUGGGAUUUCAUGUA | | UACAUGAAAUCCCAUCCCUCGUC | | 608-630 |
| AD-649246 | GAGGGAUGGGAUUUCAUGUAA | | UUACAUGAAAUCCCAUCCCUCGU | | 609-631 |
| AD-649247 | AGGGAUGGGAUUUCAUGUAAU | | AUUACAUGAAAUCCCAUCCCUCG | | 610-632 |
| AD-649248 | GGGAUGGGAUUUCAUGUAACU | | AGUUACAUGAAAUCCCAUCCCUC | | 611-633 |
| AD-649249 | GGAUGGGAUUUCAUGUAACCA | | UGGUUACAUGAAAUCCCAUCCCU | | 612-634 |
| AD-649250 | GAUGGGAUUUCAUGUAACCAA | | UUGGUUACAUGAAAUCCCAUCCC | | 613-635 |
| AD-649251 | AUGGGAUUUCAUGUAACCAAU | | AUUGGUUACAUGAAAUCCCAUCC | | 614-636 |
| AD-649252 | GGGAUUUCAUGUAACCAAGAU | | AUCUUGGUUACAUGAAAUCCCAU | | 616-638 |
| AD-649253 | GGAUUUCAUGUAACCAAGAGU | | ACUCUUGGUUACAUGAAAUCCCA | | 617-639 |
| AD-649254 | GAUUUCAUGUAACCAAGAGUA | | UACUCUUGGUUACAUGAAAUCCC | | 618-640 |
| AD-649255 | AUUUCAUGUAACCAAGAGUAU | | AUACUCUUGGUUACAUGAAAUCC | | 619-641 |
| AD-649256 | UUCAUGUAACCAAGAGUAUUU | | AAAUACUCUUGGUUACAUGAAAU | | 621-643 |
| AD-649258 | CAUGUAACCAAGAGUAUUCCA | | UGGAAUACUCUUGGUUACAUGAA | | 623-645 |
| AD-649259 | AUGUAACCAAGAGUAUUCCAU | | AUGGAAUACUCUUGGUUACAUGA | | 624-646 |
| AD-649260 | GUAACCAAGAGUAUUCCAUUU | | AAAUGGAAUACUCUUGGUUACAU | | 626-648 |
| AD-649261 | UAACCAAGAGUAUUCCAUUUU | | AAAAUGGAAUACUCUUGGUUACA | | 627-649 |
| AD-649262 | ACCAAGAGUAUUCCAUUUUUA | | UAAAAUGGAAUACUCUUGGUUA | | 629-651 |
| AD-649263 | CCAAGAGUAUUCCAUUUUUAU | | AUAAAAUGGAAUACUCUUGGUU | | 630-652 |
| AD-649264 | CAAGAGUAUUCCAUUUUUACU | | AGUAAAAUGGAAUACUCUUGGU | | 631-653 |
| AD-649265 | AAGAGUAUUCCAUUUUUACUA | | UAGUAAAAUGGAAUACUCUUGG | | 632-654 |

TABLE 2-continued

Unmodified Sense and Antisense Strand Sequences of TTR dsRNA Agents

| Duplex Name | Sense Sequence 5' to 3' | SEQ ID NO: | Antisense Sequence 5' to 3' | SEQ ID NO: | Range in NM_000371.4 |
|---|---|---|---|---|---|
| AD-649266 | AGAGUAUUCCAUUUUUACUAA | | UUAGUAAAAAUGGAAUACUCUUG | | 633-655 |
| AD-649267 | GAGUAUUCCAUUUUUACUAAA | | UUUAGUAAAAAUGGAAUACUCUU | | 634-656 |
| AD-649268 | AGUAUUCCAUUUUUACUAAAU | | AUUUAGUAAAAAUGGAAUACUCU | | 635-657 |
| AD-649269 | GUAUUCCAUUUUUACUAAAGU | | ACUUUAGUAAAAAUGGAAUACUC | | 636-658 |
| AD-649270 | UAUUCCAUUUUUACUAAAGCA | | UGCUUUAGUAAAAAUGGAAUACU | | 637-659 |
| AD-649271 | AUUCCAUUUUUACUAAAGCAU | | AUGCUUUAGUAAAAAUGGAAUAC | | 638-660 |
| AD-649272 | UUCCAUUUUUACUAAAGCAGU | | ACUGCUUUAGUAAAAAUGGAAUA | | 639-661 |
| AD-649274 | CCAUUUUUACUAAAGCAGUGU | | ACACUGCUUUAGUAAAAAUGGAA | | 641-663 |
| AD-649275 | CAUUUUUACUAAAGCAGUGUU | | AACACUGCUUUAGUAAAAAUGGA | | 642-664 |
| AD-649276 | AUUUUUACUAAAGCAGUGUUU | | AAACACUGCUUUAGUAAAAAUGG | | 643-665 |
| AD-649277 | UUUUACUAAAGCAGUGUUUUU | | AAAAACACUGCUUUAGUAAAAAU | | 645-667 |
| AD-649278 | UUUACUAAAGCAGUGUUUUCA | | UGAAAACACUGCUUUAGUAAAAA | | 646-668 |
| AD-649279 | UUACUAAAGCAGUGUUUUCAU | | AUGAAAACACUGCUUUAGUAAAA | | 647-669 |
| AD-649280 | UACUAAAGCAGUGUUUUCACU | | AGUGAAAACACUGCUUUAGUAAA | | 648-670 |
| AD-649281 | ACUAAAGCAGUGUUUUCACCU | | AGGUGAAAACACUGCUUUAGUAA | | 649-671 |
| AD-649282 | CUAAAGCAGUGUUUUCACCUU | | AAGGUGAAAACACUGCUUUAGUA | | 650-672 |
| AD-649283 | UAAAGCAGUGUUUUCACCUCA | | UGAGGUGAAAACACUGCUUUAGU | | 651-673 |
| AD-649284 | AAAGCAGUGUUUUCACCUCAU | | AUGAGGUGAAAACACUGCUUUAG | | 652-674 |
| AD-649285 | AAGCAGUGUUUUCACCUCAUA | | UAUGAGGUGAAAACACUGCUUUA | | 653-675 |
| AD-649286 | AGCAGUGUUUUCACCUCAUAU | | AUAUGAGGUGAAAACACUGCUUU | | 654-676 |
| AD-649287 | AGAAGUCCAGGCAGAGACAAU | | AUUGUCUCUGCCUGGACUUCUAA | | 683-705 |
| AD-649288 | GAAGUCCAGGCAGAGACAAUA | | UAUUGUCUCUGCCUGGACUUCUA | | 684-706 |
| AD-649290 | AGUCCAGGCAGAGACAAUAAA | | UUUAUUGUCUCUGCCUGGACUUC | | 686-708 |
| AD-649291 | GUCCAGGCAGAGACAAUAAAA | | UUUUAUUGUCUCUGCCUGGACUU | | 687-709 |
| AD-649292 | UCCAGGCAGAGACAAUAAAAU | | AUUUUAUUGUCUCUGCCUGGACU | | 688-710 |
| AD-649293 | CCAGGCAGAGACAAUAAAACA | | UGUUUUAUUGUCUCUGCCUGGAC | | 689-711 |
| AD-649294 | CAGGCAGAGACAAUAAAACAU | | AUGUUUUAUUGUCUCUGCCUGGA | | 690-712 |
| AD-649295 | AGGCAGAGACAAUAAAACAUU | | AAUGUUUUAUUGUCUCUGCCUGG | | 691-713 |
| AD-649296 | GGCAGAGACAAUAAAACAUUU | | AAAUGUUUUAUUGUCUCUGCCUG | | 692-714 |
| AD-649297 | GCAGAGACAAUAAAACAUUCU | | AGAAUGUUUUAUUGUCUCUGCCU | | 693-715 |
| AD-649298 | AGAGACAAUAAAACAUUCCUU | | AAGGAAUGUUUUAUUGUCUCUGC | | 695-717 |
| AD-649299 | GAGACAAUAAAACAUUCCUGU | | ACAGGAAUGUUUUAUUGUCUCUG | | 696-718 |
| AD-649300 | AGACAAUAAAACAUUCCUGUU | | AACAGGAAUGUUUUAUUGUCUCU | | 697-719 |
| AD-649301 | GACAAUAAAACAUUCCUGUGA | | UCACAGGAAUGUUUUAUUGUCUC | | 698-720 |
| AD-649302 | ACAAUAAAACAUUCCUGUGAA | | UUCACAGGAAUGUUUUAUUGUCU | | 699-721 |
| AD-649303 | AAUAAAACAUUCCUGUGAAAU | | AUUUCACAGGAAUGUUUUAUUGU | | 701-723 |
| AD-649304 | AUAAAACAUUCCUGUGAAAGU | | ACUUUCACAGGAAUGUUUUAUUG | | 702-724 |
| AD-649305 | UAAAACAUUCCUGUGAAAGGU | | ACCUUUCACAGGAAUGUUUUAUU | | 703-725 |

TABLE 2-continued

Unmodified Sense and Antisense Strand Sequences of TTR dsRNA Agents

| Duplex Name | Sense Sequence 5' to 3' | SEQ ID NO: | Antisense Sequence 5' to 3' | SEQ ID NO: | Range in NM_000371.4 |
|---|---|---|---|---|---|
| AD-649306 | AAAACAUUCCUGUGAAAGGCA | | UGCCUUUCACAGGAAUGUUUUAU | | 704-726 |
| AD-649307 | AAACAUUCCUGUGAAAGGCAU | | AUGCCUUUCACAGGAAUGUUUUA | | 705-727 |
| AD-649308 | AACAUUCCUGUGAAAGGCACU | | AGUGCCUUUCACAGGAAUGUUUU | | 706-728 |
| AD-649309 | ACAUUCCUGUGAAAGGCACUU | | AAGUGCCUUUCACAGGAAUGUUU | | 707-729 |
| AD-649310 | CAUUCCUGUGAAAGGCACUUU | | AAAGUGCCUUUCACAGGAAUGUU | | 708-730 |
| AD-649311 | AUUCCUGUGAAAGGCACUUUU | | AAAAGUGCCUUUCACAGGAAUGU | | 709-731 |
| AD-649312 | UUCCUGUGAAAGGCACUUUUU | | AAAAAGUGCCUUUCACAGGAAUG | | 710-732 |
| AD-649313 | UCCUGUGAAAGGCACUUUUCA | | UGAAAAGUGCCUUUCACAGGAAU | | 711-733 |
| AD-649314 | CCUGUGAAAGGCACUUUUCAU | | AUGAAAAGUGCCUUUCACAGGAA | | 712-734 |
| AD-649315 | CUGUGAAAGGCACUUUUCAUU | | AAUGAAAAGUGCCUUUCACAGGA | | 713-735 |
| AD-649316 | UGUGAAAGGCACUUUUCAUUU | | AAAUGAAAAGUGCCUUUCACAGG | | 714-736 |
| AD-649318 | UGAAAGGCACUUUUCAUUCCA | | UGGAAUGAAAAGUGCCUUUCACA | | 716-738 |
| AD-649319 | GAAAGGCACUUUUCAUUCCAU | | AUGGAAUGAAAAGUGCCUUUCAC | | 717-739 |
| AD-649320 | CUGAAGGACGAGGGAUGGGAU | | AUCCCATCCCUCGUCCUUCAGGU | | 600-622 |
| AD-649321 | UGAAGGACGAGGGAUGGGAUU | | AAUCCCAUCCCUCGUCCUUCAGG | | 601-623 |
| AD-649322 | GAAGGACGAGGGAUGGGAUUU | | AAAUCCCAUCCCUCGUCCUUCAG | | 602-624 |
| AD-649323 | AAGGACGAGGGAUGGGAUUUU | | AAAAUCCCAUCCCUCGUCCUUCA | | 603-625 |
| AD-649324 | AGGACGAGGGAUGGGAUUUCA | | UGAAAUCCCAUCCCUCGUCCUUC | | 604-626 |
| AD-649325 | GGACGAGGGAUGGGAUUUCAU | | AUGAAATCCCAUCCCUCGUCCUU | | 605-627 |
| AD-649326 | GACGAGGGAUGGGAUUUCAUU | | AAUGAAAUCCCAUCCCUCGUCCU | | 606-628 |
| AD-649327 | ACGAGGGAUGGGAUUUCAUGU | | ACAUGAAAUCCCAUCCCUCGUCC | | 607-629 |
| AD-649328 | CGAGGGAUGGGAUUUCAUGUA | | UACAUGAAAUCCCAUCCCUCGUC | | 608-630 |
| AD-649329 | GAGGGAUGGGAUUUCAUGUAA | | UUACATGAAAUCCCAUCCCUCGU | | 609-631 |
| AD-649330 | AGGGAUGGGAUUUCAUGUAAU | | AUUACATGAAAUCCCAUCCCUCG | | 610-632 |
| AD-649331 | GGGAUGGGAUUUCAUGUAACU | | AGUUACAUGAAAUCCCAUCCCUC | | 611-633 |
| AD-649332 | GGAUGGGAUUUCAUGUAACCA | | UGGUUACAUGAAAUCCCAUCCCU | | 612-634 |
| AD-649333 | GAUGGGAUUUCAUGUAACCAA | | UUGGUUACAUGAAAUCCCAUCCC | | 613-635 |
| AD-649334 | AUGGGAUUUCAUGUAACCAAU | | AUUGGUTACAUGAAAUCCCAUCC | | 614-636 |
| AD-649335 | UGGGAUUUCAUGUAACCAAGA | | UCUUGGTUACAUGAAAUCCCAUC | | 505-527 |
| AD-649336 | GGGAUUUCAUGUAACCAAGAU | | AUCUUGGTUACAUGAAAUCCCAU | | 616-638 |
| AD-649337 | GGAUUUCAUGUAACCAAGAGU | | ACUCUTGGUUACAUGAAAUCCCA | | 617-639 |
| AD-649338 | GAUUUCAUGUAACCAAGAGUA | | UACUCUTGGUUACAUGAAAUCCC | | 618-640 |
| AD-649339 | AUUUCAUGUAACCAAGAGUAU | | AUACUCUGGUUACAUGAAAUCC | | 619-641 |
| AD-649340 | UUUCAUGUAACCAAGAGUAUU | | AAUACUCUUGGUUACAUGAAAUC | | 620-642 |
| AD-649341 | UUCAUGUAACCAAGAGUAUUU | | AAAUACTCUUGGUUACAUGAAAU | | 621-643 |
| AD-649342 | UCAUGUAACCAAGAGUAUUCU | | AGAAUACUCUUGGUUACAUGAAA | | 622-644 |
| AD-649343 | CAUGUAACCAAGAGUAUUCCA | | UGGAAUACUCUUGGUUACAUGAA | | 623-645 |
| AD-649344 | AUGUAACCAAGAGUAUUCCAU | | AUGGAATACUCUUGGUUACAUGA | | 624-646 |

TABLE 2-continued

Unmodified Sense and Antisense Strand Sequences of TTR dsRNA Agents

| Duplex Name | Sense Sequence 5' to 3' | SEQ ID NO: | Antisense Sequence 5' to 3' | SEQ ID NO: | Range in NM_000371.4 |
|---|---|---|---|---|---|
| AD-649345 | UGUAACCAAGAGUAUUCCAUU | | AAUGGAAUACUCUUGGUUACAUG | | 625-647 |
| AD-649346 | GUAACCAAGAGUAUUCCAUUU | | AAAUGGAAUACUCUUGGUUACAU | | 626-648 |
| AD-649347 | UAACCAAGAGUAUUCCAUUUU | | AAAAUGGAAUACUCUUGGUUACA | | 627-649 |
| AD-649348 | ACCAAGAGUAUUCCAUUUUUA | | UAAAAATGGAAUACUCUUGGUUA | | 629-651 |
| AD-649349 | CCAAGAGUAUUCCAUUUUUAU | | AUAAAAUGGAAUACUCUUGGUU | | 630-652 |
| AD-649350 | CAAGAGUAUUCCAUUUUUACU | | AGUAAAAUGGAAUACUCUUGGU | | 631-653 |
| AD-649351 | AAGAGUAUUCCAUUUUUACUA | | UAGUAAAAUGGAAUACUCUUGG | | 632-654 |
| AD-649352 | AGAGUAUUCCAUUUUUACUAA | | UUAGUAAAAUGGAAUACUCUUG | | 633-655 |
| AD-649353 | GAGUAUUCCAUUUUUACUAAA | | UUUAGUAAAAUGGAAUACUCUU | | 634-656 |
| AD-649354 | AGUAUUCCAUUUUUACUAAAU | | AUUUAGUAAAAUGGAAUACUCU | | 635-657 |
| AD-649355 | GUAUUCCAUUUUUACUAAAGU | | ACUUUAGUAAAAUGGAAUACUC | | 636-658 |
| AD-649356 | UAUUCCAUUUUUACUAAAGCA | | UGCUUUAGUAAAAUGGAAUACU | | 637-659 |
| AD-649357 | AUUCCAUUUUUACUAAAGCAU | | AUGCUUUAGUAAAAUGGAAUAC | | 638-660 |
| AD-649358 | UUCCAUUUUUACUAAAGCAGU | | ACUGCUUAGUAAAAUGGAAUA | | 639-661 |
| AD-649359 | UCCAUUUUUACUAAAGCAGUU | | AACUGCUUAGUAAAAUGGAAU | | 640-662 |
| AD-649360 | CCAUUUUUACUAAAGCAGUGU | | ACACUGCUUUAGUAAAAUGGAA | | 641-663 |
| AD-649361 | CAUUUUUACUAAAGCAGUGUU | | AACACTGCUUUAGUAAAAUGGA | | 642-664 |
| AD-649362 | AUUUUUACUAAAGCAGUGUUU | | AAACACTGCUUUAGUAAAAUGG | | 643-665 |
| AD-649363 | UUUUUACUAAAGCAGUGUUUU | | AAAACACUGCUUUAGUAAAAUG | | 644-666 |
| AD-649364 | UUUUACUAAAGCAGUGUUUUU | | AAAAACACUGCUUUAGUAAAAU | | 645-667 |
| AD-649365 | UUUACUAAAGCAGUGUUUUCA | | UGAAAACACUGCUUUAGUAAAA | | 646-668 |
| AD-649366 | UUACUAAAGCAGUGUUUUCAU | | AUGAAAACACUGCUUUAGUAAA | | 647-669 |
| AD-649367 | UACUAAAGCAGUGUUUUCACU | | AGUGAAAACACUGCUUUAGUAAA | | 648-670 |
| AD-649368 | ACUAAAGCAGUGUUUUCACCU | | AGGUGAAAACACUGCUUUAGUAA | | 649-671 |
| AD-649369 | CUAAAGCAGUGUUUUCACCUU | | AAGGUGAAAACACUGCUUUAGUA | | 650-672 |
| AD-649370 | UAAAGCAGUGUUUUCACCUCA | | UGAGGTGAAAACACUGCUUUAGU | | 651-673 |
| AD-649371 | AAAGCAGUGUUUUCACCUCAU | | AUGAGGTGAAAACACUGCUUUAG | | 652-674 |
| AD-649372 | AAGCAGUGUUUUCACCUCAUA | | UAUGAGGTGAAAACACUGCUUUA | | 653-675 |
| AD-649373 | AGCAGUGUUUUCACCUCAUAU | | AUAUGAGGUGAAAACACUGCUUU | | 654-676 |
| AD-649374 | AGAAGUCCAGGCAGAGACAAU | | AUUGUCUCGCCUGGACUUCUAA | | 683-705 |
| AD-649375 | GAAGUCCAGGCAGAGACAAUA | | UAUUGUCUCUGCCUGGACUUCUA | | 684-706 |
| AD-649376 | AAGUCCAGGCAGAGACAAUAA | | UUAUUGUCUCUGCCUGGACUUCU | | 685-707 |
| AD-649377 | AGUCCAGGCAGAGACAAUAAA | | UUUAUGUCUCUGCCUGGACUUC | | 686-708 |
| AD-649378 | GUCCAGGCAGAGACAAUAAAA | | UUUUAUGUCUCUGCCUGGACUU | | 687-709 |
| AD-649379 | UCCAGGCAGAGACAAUAAAAU | | AUUUUAUGUCUCUGCCUGGACU | | 688-710 |
| AD-649380 | CCAGGCAGAGACAAUAAAACA | | UGUUUUAUGUCUCUGCCUGGAC | | 689-711 |
| AD-649381 | CAGGCAGAGACAAUAAAACAU | | AUGUUUUAUGUCUCUGCCUGGA | | 690-712 |
| AD-649382 | AGGCAGAGACAAUAAAACAUU | | AAUGUUUAUUGUCUCUGCCUGG | | 691-713 |

TABLE 2-continued

Unmodified Sense and Antisense Strand Sequences of TTR dsRNA Agents

| Duplex Name | Sense Sequence 5' to 3' | SEQ ID NO: | Antisense Sequence 5' to 3' | SEQ ID NO: | Range in NM_000371.4 |
|---|---|---|---|---|---|
| AD-649383 | GGCAGAGACAAUAAAACAUUU | | AAAUGUUUAUUGUCUCUGCCUG | | 692-714 |
| AD-649384 | GCAGAGACAAUAAAACAUUCU | | AGAAUGUUUUAUUGUCUCUGCCU | | 693-715 |
| AD-649385 | AGAGACAAUAAAACAUUCCUU | | AAGGAAUGUUUUAUUGUCUCUGC | | 695-717 |
| AD-649386 | GAGACAAUAAAACAUUCCUGU | | ACAGGAAUGUUUUAUUGUCUCUG | | 696-718 |
| AD-649388 | GACAAUAAAACAUUCCUGUGA | | UCACAGGAAUGUUUUAUUGUCUC | | 698-720 |
| AD-649389 | ACAAUAAAACAUUCCUGUGAA | | UUCACAGGAAUGUUUUAUUGUCU | | 699-721 |
| AD-649390 | CAAUAAAACAUUCCUGUGAAA | | UUUCACAGGAAUGUUUUAUUGUC | | 700-722 |
| AD-649391 | AAUAAAACAUUCCUGUGAAAU | | AUUUCACAGGAAUGUUUUAUUGU | | 701-723 |
| AD-649392 | AUAAAACAUUCCUGUGAAAGU | | ACUUUCACAGGAAUGUUUUAUUG | | 702-724 |
| AD-649394 | AAAACAUUCCUGUGAAAGGCA | | UGCCUUUCACAGGAAUGUUUUAU | | 704-726 |
| AD-649395 | AAACAUUCCUGUGAAAGGCAU | | AUGCCUUUCACAGGAAUGUUUUA | | 705-727 |
| AD-649396 | AACAUUCCUGUGAAAGGCACU | | AGUGCCUUUCACAGGAAUGUUUU | | 706-728 |
| AD-649397 | ACAUUCCUGUGAAAGGCACUU | | AAGUGCCUUUCACAGGAAUGUUU | | 707-729 |
| AD-649398 | CAUUCCUGUGAAAGGCACUUU | | AAAGUGCCUUUCACAGGAAUGUU | | 708-730 |
| AD-649399 | AUUCCUGUGAAAGGCACUUUU | | AAAAGUGCCUUUCACAGGAAUGU | | 709-731 |
| AD-649400 | UUCCUGUGAAAGGCACUUUUU | | AAAAAGUGCCUUUCACAGGAAUG | | 710-732 |
| AD-649401 | UCCUGUGAAAGGCACUUUUCA | | UGAAAAGUGCCUUUCACAGGAAU | | 711-733 |
| AD-649402 | CCUGUGAAAGGCACUUUUCAU | | AUGAAAAGUGCCUUUCACAGGAA | | 712-734 |
| AD-649403 | CUGUGAAAGGCACUUUUCAUU | | AAUGAAAAGUGCCUUUCACAGGA | | 713-735 |
| AD-649404 | UGUGAAAGGCACUUUUCAUUU | | AAAUGAAAAGUGCCUUUCACAGG | | 714-736 |
| AD-649405 | GUGAAAGGCACUUUUCAUUCU | | AGAAUGAAAAGUGCCUUUCACAG | | 715-737 |
| AD-649406 | UGAAAGGCACUUUUCAUUCCA | | UGGAAUGAAAAGUGCCUUUCACA | | 716-738 |
| AD-649407 | GAAAGGCACUUUUCAUUCCAU | | AUGGAAUGAAAAGUGCCUUUCAC | | 717-739 |
| AD-68315 | UGUAACCAAGAGUAUUCCAUU | | AAUGGAAUACUCUUGGUUACAUG | | 625-647 |
| AD-68316 | AACCAAGAGUAUUCCAUUUUU | | AAAAAUGGAAUACUCUUGGUUAC | | 628-650 |
| AD-68317 | CAGAGACAAUAAAACAUUCCU | | AGGAAUGUUUUAUUGUCUCUGCC | | 694-716 |
| AD-68318 | UUUUUACUAAAGCAGUGUUUU | | AAAACACUGCUUUAGUAAAAAUG | | 644-666 |
| AD-68326 | UUUCAUGUAACCAAGAGUAUU | | AAUACUCUUGGUUACAUGAAAUC | | 620-642 |
| AD-68327 | CAAUAAAACAUUCCUGUGAAA | | UUUCACAGGAAUGUUUUAUUGUC | | 700-722 |
| AD-157442.5 | AACCAAGAGUAUUCCAUUUUU | | AAAAAUGGAAUACUCUUGGUUAC | | 628-650 |
| AD-157470.8 | CAGAGACAAUAAAACAUUCCU | | AGGAAUGUUUUAUUGUCUCUGCC | | 694-716 |
| AD-65480 | UGGGAUUUCAUGUAACCAAGA | | UCUUGGUUACAUGAAAUCCCAUC | | 505-527 |

TABLE 3

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-649237 | csusgaagGfaCfGfAfgggaugggauL96 | | asUfscccAfucccugUfcCfuucagsgsu | | ACCUGAAGGACGAGGAUGGGAU | |
| AD-649238 | usgsaaggAfcGfAfGfggauggaulL96 | | asAfsuccCfaucccugCfuCfuucasgsg | | CCUGAAGGACGAGGAUGGGAUU | |
| AD-649239 | gsasaggaCfgAfGfGfgaugggauuuL96 | | asAfsaucCfcauccucCfgUfcccuucsasg | | CUGAAGGACGAGGAUGGGAUUU | |
| AD-649240 | asasggaCfaGfGfGfgauggauuuL96 | | asAfsaauCfccaucccUfcGfuccuuscsa | | UGAAGGACGAGGAUGGGAUUUC | |
| AD-649241 | asggsacgAfgGfGfAfugggauuucaL96 | | usGfsaaaUfcccauccfuCfguccusususc | | GAAGGACGAGGGAUGGGAUUUCA | |
| AD-649242 | gsgsacgaGfgGfAfUfgggauuucauL96 | | asUfsgaaAfuccauccCfcUfcguccusu | | AAGGACGAGGAUGGGAUUUCAU | |
| AD-649243 | gsascgagGfgAfUfGfggauuucauL96 | | asAfsugaAfauccauCfcCfucgucscsu | | AGGACGAGGAUGGGAUUUCAUG | |
| AD-649244 | ascsgaggGfaUfGfGfgauuucaugU96 | | asCfsaugAfaauccaUfcCfcucgucsc | | GGACGAGGAUGGGAUUUCAUGU | |
| AD-649245 | csgsaggGfaUfGfGfauuucaugua196 | | usAfscauGfaaauccCfaUfcccucsgsu | | GACGAGGAUGGGAUUUCAUGUA | |
| AD-649246 | gsasagggAfuGfGfAfuuucauguaaL96 | | usUfsacaUfgaaauccfaUfcccucscsg | | ACGAGGAUGGGAUUUCAUGUAA | |
| AD-649247 | asgsggggAfuGfGfAfUfuucauguaacsg | | asUfsuacAfugaaauccCfcAfucccuscsg | | CGAGGAUGGGAUUUCAUGUAAC | |
| AD-649248 | gsgsgaugGfgAfUfUfucauguaaccL96 | | asGfsuuaCfaugaaauCfcCfaucccuscsu | | GAGGGAUGGGAUUUCAUGUAACC | |
| AD-649249 | gsgsauggGfaUfUfUfCfcauguaaccaL96 | | usGfsguuAfcaugaaaUfcCfcauccscsu | | AGGGAUGGGAUUUCAUGUAACCA | |
| AD-649250 | gsasugggAfuUfUfCfcauguaaccaL96 | | usUfsgguUfacaugaAfuCfccaucscsc | | GGGAUGGGAUUUCAUGUAACCAA | |
| AD-649251 | asusgggaUfuUfCfAfuguaaccaauL96 | | asUfsuggUfuacaugAfaUfcccauscsc | | GGAUGGGAUUUCAUGUAACCAAG | |

TABLE 3-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence |
|---|---|---|---|---|---|
| AD-649252 | gsgsgauuUfcAfUfGfuaaccaagauL96 | | asUfscuuGfguuacaucGfaAfauccsasu | | AUGGGAUUCAUGUAACCAAGAG |
| AD-649253 | gggsauuuCfaUfGfUfaaccaagaguL96 | | ascCfsucuUfgguuacaUfgAfaauccscsa | | UGGGAUUCAUGUAACCAAGAGU |
| AD-649254 | gsauuucAfuGfUfAfAfaccaagagtaL96 | | usAfscucUfugguuacAfuGfaaaucscsc | | GGGAUUCAUGUAACCAAGAGUA |
| AD-649255 | asusuucAfugUfAfAfccaagaguatuL96 | | asUfsacuCfuugguuaCfaUfgaaauscsc | | GGAUUCAUGUAACCAAGAGUAU |
| AD-649256 | ususucaugUfaAfCfCfaagaguauuuL96 | | asAfsauaCfucuugguUfaCfaugaasasu | | AUUCAUGUAACCAAGAGUAUUC |
| AD-649258 | csasuguaAfccCfAfAfgaguauuccaL96 | | usGfsggaUfacucuugGfuUfacaugsasa | | UCAUGUAACCAAGAGUAUUCCA |
| AD-649259 | asusguaaCfcAfAfGfagauuccauL96 | | asAfsaugGfauaugGfuUfacaugsasu | | AUGUAACCAAGAGUAUUCCAU |
| AD-649260 | gsusaaccAfaGfAfGfuauuccatUfL96 | | asAfsaugGfauacucUfuGfguuascsa | | UGUAACCAAGAGUAUUCCAUUU |
| AD-649261 | usasaccaAfgAfGfUfauuccauuuUfL96 | | asAfsaaaAfuggaauaCfuCfuuggusus | | UAACCAAGAGUAUUCCAUUUUA |
| AD-649262 | ascscaagAfgUfAfUfuccauuuuaL96 | | asUfsaaaAfauggaauAfcUfcuuggsus | | AACCAAGAGUAUUCCAUUUUAC |
| AD-649263 | cscsaagaGfuAfUfUfccauuuuacuL96 | | asGfsuaaAfaauggaUfaCfucuggsgsu | | ACCAAGAGUAUUCCAUUUUACU |
| AD-649264 | csasagaUfaUfUfCfcauuuuacuL96 | | usAfsguaAfaauggAfuAfcucuugs | | CCAAGAGUAUUCCAUUUUACUA |
| AD-649265 | asasgaguAfuUfCfCfauuuuacuaL96 | | usUfsaguAfaaaugAfuAfacucusus | | CAAGAGUAUUCCAUUUUACUAA |
| AD-649266 | asgsaguaUfuCfCfAfuuuuacuaaL96 | | usUfsaguAfaaaugAfuAfacucsusu | | AAGAGUAUUCCAUUUUACUAAA |
| AD-649267 | gsasguauUfcCfAfUfuuuacuaaaL96 | | usUfsuagUfaaaaugGfaAfuacucsusu | | AAGAGUAUUCCAUUUUACUAAA |
| AD-649268 | asgsuauuCfcAfUfUfUfuacuaaauL96 | | asUfsuuaGfuaaaauGfgAfauacucscu | | AGAGUAUUCCAUUUUACUAAAG |

TABLE 3-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-649269 | gsusauucCfaUfUfGfuuacuaaaguuL96 | | asCfsuuuAfguaaaaUfgGfaauacsusc | | GAGUAUCCAUUUUACUAAAGC | |
| AD-649270 | usasuuccAfuUfUfUfuacuaaagcaL96 | | usGfscuuUfaguaaaAfuGfaauauascsu | | AGUAUCCAUUUUACUAAAGCA | |
| AD-649271 | asusuccaUfuUfUfUfUfacuaaagcauL96 | | asUfsgcuUfuaguaaAfaUfggaauuasasc | | GUAUCCAUUUUACUAAAGCAG | |
| AD-649272 | ususccauUfuUfUfAfcuaaagcaguU96 | | asCfsugcUfuuaguaaAfaAfuggaaususa | | UAUCCAUUUUACUAAAGCAGU | |
| AD-649274 | cscsauuuUfuAfCfUfaaaagcagugUfL96 | | asCfsacuGfcuuuaguAfaAfaauggsasa | | UUCCAUUUUACUAAAGCAGUGU | |
| AD-649275 | csasuuuuUfacUfCfUfAfaaagcaguguuL96 | | asAfscacUfgcuuuagUfaAfaaauggsa | | UCCAUUUUACUAAAGCAGUGUU | |
| AD-649276 | asusuuuuAfcUfCfAfAfAfagcaguguuuL96 | | asAfsaaaCfugcuuuaGfuAfaaaausgsg | | CCAUUUUACUAAAGCAGUGUUU | |
| AD-649277 | ususuuuacUfaAfAfGfcaguguuuucaL96 | | asAfsaaaCfacugcuuUfaAfuaaaasasu | | AUUUUACUAAAGCAGUGUUUC | |
| AD-649278 | ususuacuAfaAfGfCfAfaguguuuucaL96 | | usGfsaaaAfcacugcuUfuAfguaaasasa | | UUUUACUAAAGCAGUGUUUUCA | |
| AD-649279 | ususacuaAfaGfCfAfguguuuucacuL96 | | asUfsgaaAfacacugCfuUfuaguaasasa | | UUUACUAAAGCAGUGUUUCAC | |
| AD-649280 | usascuaaAfgCfAfGfUfguuuucaccuL96 | | asGfsugaAfaacacugCfuUfiuaguasasa | | UUACUAAAGCAGUGUUUCACC | |
| AD-649281 | ascsuaaaGfcAfGfGfUfguuuucaccuL96 | | asGfsgugAfaaacacUfgCfuuuuagsusa | | UUACUAAAGCAGUGUUUCACCU | |
| AD-649282 | csusaaagCfaGfUfGfuuuuuccacuuL96 | | asAfsgguUfgaaaacaCfgCfuuuuagsusa | | UACUAAAGCAGUGUUUCACCUC | |
| AD-649283 | usasaagcAfgUfGfUfuuuuaccucaL96 | | usGfsaggUfgaaaacaCfuGfcuuuasgsu | | ACUAAAGCAGUGUUUCACCUCA | |
| AD-649284 | asasagcaGfuGfUfUfuucaccucauL96 | | asUfsgagGfugaaaacAfcUfgcuuuasasg | | CUAAAGCAGUGUUUCACCUCAU | |

TABLE 3-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-649285 | asasgcagUfgUfUfUfucaccucauaL96 | | usAfsugaGfgugaaaCfaCfugcuususa | | UAAAGCAGUGUUUCACCUCAUA | |
| AD-649286 | aggscaguGfuUfUfUfUfcaccucauauL96 | | asUfsaugAfggugaaAfcAfcugcucusu | | AAAGCAGUGUUUCACCUCAUAU | |
| AD-649287 | aggsaaguCfcAfGfGfcagagacaauL96 | | asUfsuguCfucugccuGfgAfcuucucusa | | UUAGAAGUCCAGGCAGAGACAAU | |
| AD-649288 | gsasaguccfaGfGfCfagagacaauaL96 | | usAfsuugUfcucugccUfgGfacuucusa | | UAGAAGUCCAGGCAGAGACAAUA | |
| AD-649290 | aggsuccaGfgCfAfGfagacaauaaaL96 | | usUfsuauUfgcucucgCfcUfggacususu | | GAAGUCCAGGCAGAGACAAUAAA | |
| AD-649291 | gsusccaggCfgCfAfGfAfgacaauaaaaL96 | | usUfsuuaUfugucucuGfcCfuggacusu | | AAGUCCAGGCAGAGACAAUAAAA | |
| AD-649292 | uscscaggCfaGfAfGfacaauaaaauL96 | | asUfsuuuAfuugucuCfUfgCfccuggasu | | AGUCCAGGCAGAGACAAUAAAAC | |
| AD-649293 | cscsaggcAfgAfGfAfcaauaaaacaL96 | | usGfsuuUfauugucuCfuGfccuggsac | | GUCCAGGCAGAGACAAUAAAACA | |
| AD-649294 | csasggcaGfaGfAfCfaauaaaacauL96 | | asUfsguuUfuauugucUfcUfgccugsa | | UCCAGGCAGAGACAAUAAAACAU | |
| AD-649295 | aggsgcagAfgAfCfAfAfauaaaacauuL96 | | asAfsuguUfuuauugCfuCfugccusg | | CCAGGCAGAGACAAUAAAACAUU | |
| AD-649296 | gsgscagaGfacAfCfAfAfuaaaacauuuL96 | | asAfsauguUfuuuaugUfcUfcugccusg | | CAGGCAGAGACAAUAAAACAUUC | |
| AD-649297 | gcsagagAfcAfAfUfaaaacauucuL96 | | asGfsaauGfuuuauuGfuCfucugcscs | | AGGCAGAGACAAUAAAACAUUCC | |
| AD-649298 | aggsagaCfaAfAfAfaacauuccuuL96 | | asAfsggaAfuguuuuaUfuGfucucusg | | GCAGAGACAAUAAAACAUUCCUG | |
| AD-649299 | gsasgacaAfuAfAfAfacauccuguL96 | | asCfsaggAfauuuuAfuUfguucucusg | | CAGAGACAAUAAAACAUUCCUGU | |
| AD-649300 | asgsacaUfaAfAfAfcauccugugL96 | | asAfscaggAfaugauuUfaUfugucuscu | | AGAGACAAUAAAACAUUCCUGUG | |
| AD-649301 | gsascaauAfaAfAfCfauuccugugaL96 | | usCfsacaGfgaaguUfuAfugucuscsc | | GAGACAAUAAAACAUUCCUGUGA | |

TABLE 3-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-649302 | ascsaauaAfaAfCfAfuuccugugaaL96 | | usUfscacAfggaaugUfuUfauuguscsu | | AGACAAUAAAACAUUCCUGUGAA | |
| AD-649303 | asasuaaaAfcAfUfUfccugugaaauL96 | | asUfsuucAfcaggaauGfuUfuuauusgsu | | ACAAUAAAACAUUCCUGUGAAAG | |
| AD-649304 | asusaaaaCfaUfUfCfccugugaaaguL96 | | asCfsuuuCfacaggaAfUfguuuauusus g | | CAAUAAAACAUUCCUGUGAAAGG | |
| AD-649305 | usasaaaaCfuUfCfCfugugaaaagguL96 | | asCfscuuUfcacaggaAfuGfuuuuausu | | AAUAAAACAUUCCUGUGAAAGGC | |
| AD-649306 | asasaacaUfuCfCfUfgugaaaggcaL96 | | usGfsccuUfcacaggAfaUfguuuusasu | | AUAAAACAUUCCUGUGAAAGGCA | |
| AD-649307 | asasacauUfccCfUfgugaaaggcauL96 | | asUfsgcCfuucacagGfaAfuguuusua | | UAAAACAUUCCUGUGAAAGGCAC | |
| AD-649308 | asascauuCfcCfUfGfUfgaaaggcacuL96 | | asGfsugcCfuuucacaGfgAfaugusus | | AAAACAUUCCUGUGAAAGGCACU | |
| AD-649309 | ascsauuCfuGfUfGfUfgaaaggcacuL96 | | asAfsaguGfccuuucaCfaGfaaugusu | | AAACAUUCCUGUGAAAGGCACUU | |
| AD-649310 | csasuuccUfgUfGfAfaaaggcacuuL96 | | asAfsaguUfgccuuucaCfaGfgaaugsusu | | ACAUUCCUGUGAAAGGCACUUU | |
| AD-649311 | asusuccUfgUfGfAfAfaggcacuuuL96 | | asAfsaagUfgccuuucfaCfAfggaausgs u | | ACAUUCCUGUGAAAGGCACUUUU | |
| AD-649312 | ususccugUfgAfAfAfaggcacuuuuL96 | | asAfsaaaGfugccuuuCfaCfaggaasusg | | CAUUCCUGUGAAAGGCACUUUUC | |
| AD-649313 | uscscuguGfaAfAfAfgcccuuUfcAfcaggasasu | | usGfsaaaAfgugccuuUfcAfcaggasasu | | AUUCCUGUGAAAGGCACUUUUCA | |
| AD-649314 | cscsuguGfaAfAfGfGfcacuuuucauL96 | | asUfsgaaAfagugcCfuUfuCfcacaggsasa | | UUCCUGUGAAAGGCACUUUUCAU | |
| AD-649315 | csusgugaAfaGfGfCfCfacuuuucauuL96 | | asAfsugaAfaagugccUfuUfcacagsgsa | | UCCUGUGAAAGGCACUUUUCAUU | |
| AD-649316 | usgsgugaAfgGfCfCfAfcuuuucauuuL96 | | asAfsaugAfaaaugcCfuUfucacasgsg | | CCUGUGAAAGGCACUUUUCAUUC | |

TABLE 3-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-649318 | usgsaaagGfcAfCfUfuuucauuccaL96 | | usGfsgaaUfgaaaagUfcCfuuucascsa | | UGUGAAAGGCACUUUCAUUCCA | |
| AD-649319 | gsasaaagCfacCfUfUfuucauuccaaL96 | | asUfsgaaUfugaaaagUfgCfcuuucsasc | | GUGAAAGGCACUUUCAUUCCAC | |
| AD-649320 | csusgaagGfacCfGfAfgggauggauL96 | | asUfscccAf(Tgn)cccucgUfcCfuucag sgsu | | ACCUGAAGGACGAGGGAUGGGAU | |
| AD-649321 | usgsaagGfcAfGfGfgauggauuL96 | | asAfsuccCf(Agn)ucccucGfuCfcuuca sgsg | | CCUGAAGGACGAGGGAUGGGAUU | |
| AD-649322 | gsaasggaCfgAfGfGfgauggauuuL96 | | asAfsaucCf(Cgn)aucccuCfgUfccuuc saag | | CUGAAGGACGAGGGAUGGGAUUU | |
| AD-649323 | asasaggaCfGfaGfGfGfauggauuuuL96 | | asAfsaauCf(Cgn)caucccUfcGfuccuu scsa | | UGAAGGACGAGGGAUGGGAUUUC | |
| AD-649324 | asgsgacGfAfgGfGfAfugagauuucaL96 | | usGfsaaaUf(Cgn)ccauccCfuCfguccu susu | | GAAGGACGAGGGAUGGGAUUUCA | |
| AD-649325 | gsgsacgaGfgGfGfAfUfgggauucauL96 | | asGfsaaaAf(Tgn)cccaucCfcUfcguc susu | | AAGGACGAGGGAUGGGAUUUCAU | |
| AD-649326 | gsasccgagGfgAfUfGfGfgauucauL96 | | asAfsugaAf(Agn)ucccauCfcCfucgu cscsu | | AGGACGAGGGAUGGGAUUUCAUG | |
| AD-649327 | ascscgagGfaUfGfGfgauuucaugL96 | | asCfsaugaAf(Agn)auccccaUfcCfucgu scsc | | GGACGAGGGAUGGGAUUUCAUGU | |
| AD-649328 | csgsaggGfAfuGfGfGfauuucauguaL96 | | usAfscaugGf(Cgn)aauccaUfcCfccuc gsusc | | GACGAGGGAUGGGAUUUCAUGUA | |
| AD-649329 | gsasggGfAfuGfGfGfAfuuucauguaaL96 | | usUfsaca(Tgn)gaaaucccCfaUfcccucs gsu | | ACGAGGGAUGGGAUUUCAUGUAA | |
| AD-649330 | asgsgggauGfGfAfUfUfuucauguaauL96 | | asUfsuacAf(Tgn)gaaaucUfcCfauccc scsg | | CGAGGGAUGGGAUUUCAUGUAAC | |
| AD-649331 | gsgsatGfgGfAfUfUfucauguaacuL96 | | asGfsuuaCf(Agn)ugaaauCfcCfauccc susc | | GAGGGAUGGGAUUUCAUGUAACC | |
| AD-649332 | gsgsauggGfaUfUfUfCfauguaaccaL96 | | usGfsguuAf(Cgn)auguaaUfCfcauc cscsu | | AGGGAUGGGAUUUCAUGUAACCA | |
| AD-649333 | gsasugggAfuUfUfCfauguaaccaaL96 | | usUfsgguUf(Agn)caugaaAfuCfccau cscsc | | GGGAUGGGAUUUCAUGUAACCAA | |

TABLE 3-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-649334 | asusgggaUfuUfCfAfaguaaccaauuL96 | | asUfsuggUf(Tgn)acaugaAfaUfcccauscsc | | GGAUGGGAUUUCAUGUAACCAAG | |
| AD-649335 | ugsgsgauUfuCfAfUfguaaccaagaL96 | | usCfsuugGf(Tgn)uacaugAfaAfucccasusc | | GAUGGGAUUUCAUGUAACCAAGA | |
| AD-649336 | gsgsgauuUfcAfUfGfuaaccaagauL96 | | asUfscuuGf(Tgn)uacaugGfaAfaucccsasu | | AUGGGAUUUCAUGUAACCAAGAG | |
| AD-649337 | gsgsgauuuCfaUfGfUfaaccaagaguL96 | | ascFfsucu(Tgn)gguuacaUfgAfaauccscsa | | UGGGAUUUCAUGUAACCAAGAGU | |
| AD-649338 | gsasuuucAfuGfUfAfaccaagaguaL96 | | usAfscucUf(Tgn)gguuacAfuGfaaaucscsc | | GGGAUUUCAUGUAACCAAGAGUA | |
| AD-649339 | asusuuucAfuGfUfAfAfccaagaguauL96 | | asUfsacuCf(Tgn)ugguuacTfaUfgaaauscsc | | GGAUUUCAUGUAACCAAGAGUAU | |
| AD-649340 | ususucauGfuAfAfCfcaagaguauuL96 | | asAfsuacUf(Cgn)uugguuAfcAfugaaasusc | | GAUUUCAUGUAACCAAGAGUAUU | |
| AD-649341 | ususcaugUfaAfCfCfaagaguauuuL96 | | asAfsauaCf(Tgn)cuugguUfaCfaugaasasu | | AUUUCAUGUAACCAAGAGUAUUC | |
| AD-649342 | usesaugUfaAfaCfCfAfaagaguauucuL96 | | asGfsgaaUf(Agn)cucuugGfuUfacauasasa | | UUUCAUGUAACCAAGAGUAUUCC | |
| AD-649343 | ceasuguaAfccCfAfAfgaguauuccaL96 | | uGfsgaaUf(Agn)cucuugGfuUfacaugsasa | | UCAUGUAACCAAGAGUAUUCCA | |
| AD-649344 | asusuguaaCfcAfAfGfAfguauuccauL96 | | asUfsggaAf(Tgn)acucuuGfgUfuacusgsa | | CAUGUAACCAAGAGUAUUCCAU | |
| AD-649345 | usgsuaaCfCfaAfGfAfGfuauuccauuL96 | | asAfsuggAf(Agn)uacucuUfgGfuuacasusg | | AUGUAACCAAGAGUAUUCCAUU | |
| AD-649346 | gsusuaaccAfaGfAfGfuauuccauuuL96 | | asAfsaugGf(Agn)auacucUfuGfguuacsasu | | UGUAACCAAGAGUAUUCCAUUU | |
| AD-649347 | usasaccaAfgAfGfUfauuccauuuuL96 | | asAfsaauGf(Agn)auacucCfuUfgguuascsa | | GUAACCAAGAGUAUUCCAUUUU | |
| AD-649348 | ascscaagAfgUfAfUfuccauuuuuaL96 | | usAfsaaaAf(Tgn)ggaauaCfuCfuuggususa | | UAACCAAGAGUAUUCCAUUUUA | |

TABLE 3-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence |
|---|---|---|---|---|---|
| AD-649349 | cscsaagaGfuAfUfUfccauuuuauL96 | | asUfsaaaAf(Agn)uggaauAfcUfcuugsusu | | AACCAAGAGUAUUCCAUUUUAC |
| AD-649350 | csasagagUfaUfUfCCcauuuuuacuL96 | | asGfsuaaAf(Agn)auggaaUfaCfucuugsgsu | | ACCAAGAGUAUUCCAUUUUACU |
| AD-649351 | asasgaguAfuUfCfCfauuuuuacuaL96 | | usAfsguaAf(Agn)aauggaAfuAfcucuusgsg | | CCAAGAGUAUUCCAUUUUACUA |
| AD-649352 | asgsaguaUfuCfCfAfuuuuuacuaaL96 | | usUfsaguAf(Agn)aauggAfaUfacucususg | | CAAGAGUAUUCCAUUUUACUAA |
| AD-649353 | gsasguauUfcCfAfUfuuuuacuaaaL96 | | usUfsuagUf(Agn)aaaaugGfaAfuacucsusu | | AAGAGUAUUCCAUUUUACUAAA |
| AD-649354 | asgguauuCfcAfUfUfuuuuacuaaauL96 | | asUfsuuaGf(Tgn)aaaaauUfgAfauacuscsu | | AGAGUAUUCCAUUUUACUAAAG |
| AD-649355 | gsusauucCfaUfUfUfuacuaaagL96 | | asCfsuuu(Agn)guaaaaaUfgGfaauacsuse | | GAGUAUUCCAUUUUACUAAAGC |
| AD-649356 | usasuuccAfuUfUfUfacuaaagcaL96 | | usGfscuuUf(Agn)guaaaaAfuGfgaauascsu | | AGUAUUCCAUUUUACUAAAGCA |
| AD-649357 | asusuccaUfuUfUfUfacuaaagcauL96 | | asUfsgcuUf(Tgn)aguaaaAfaUfggaausasc | | GUAUUCCAUUUUACUAAAGCAG |
| AD-649358 | ususccauUfuUfUfAfcuaaagcaguL96 | | asCfsugcUf(Tgn)uaguaaAfaAfuggaasusa | | UAUUCCAUUUUACUAAAGCAGU |
| AD-649359 | uscscauuUfuUfAfCfuaaagcaguuL96 | | asAfscugCf(Tgn)uuaguaAfaAfauggasasu | | AUUCCAUUUUACUAAAGCAGUG |
| AD-649360 | cscsauuuUfuAfCfUfaaagcagugL96 | | asCfsacuGf(Cgn)uuuaguAfaAfaauggsasg | | UUCCAUUUUACUAAAGCAGUGU |
| AD-649361 | csasuuuuUfacfUfUfAfaagcagugugsgsa | | asAfsacac(Tgn)gcuuuaGfuAfaaaugsgsa | | UCCAUUUUACUAAAGCAGUGUU |
| AD-649362 | asusuuuaAfcUfAfAfagcaguguuL96 | | asAfsaacaCf(Tgn)gcuuuaGfuAfaaauasgsg | | CCAUUUUACUAAAGCAGUGUUU |
| AD-649363 | ususuuuaCfuAfAfAfgcaguguuuL96 | | asAfsaacAf(Cgn)ugcuuuAfgUfaaaaasusg | | CAUUUUACUAAAGCAGUGUUUU |
| AD-649364 | ususuuacUfaAfAfGfcaguguuuuL96 | | asAfsaaaCf(Agn)cugcuuUfaGfuaaaasasu | | AUUUUACUAAAGCAGUGUUUUC |

TABLE 3-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-649365 | ususuacuAfaAfGfCfaguguuuucaL96 | | usGfsaaaAf(Cgn)acugcuUfuAfguaaasasa | | UUUUUACUAAAGCAGUGUUUUCA | |
| AD-649366 | ususacuaAfaGfCfAfguguuuucauL96 | | asUfsgaaAf(Agn)cacugcUfuUfaguaasasa | | UUUUACUAAAGCAGUGUUUUCAC | |
| AD-649367 | uasucuaaAfgCfAfGfuguuuucaccL96 | | asGfsugaAf(Agn)acacugCfuUfuaguasasa | | UUUACUAAAGCAGUGUUUUCACC | |
| AD-649368 | ascsuaaaGfcAfGfUfguuuucaccuL96 | | asGfsgugAf(Agn)aacacuGfcUfuuagusasa | | UUACUAAAGCAGUGUUUUCACCU | |
| AD-649369 | csusaaagCfaGfUfGfuuuucaccuuL96 | | asAfsguGf(Agn)aaacacUfgCfuuuagsusa | | UACUAAAGCAGUGUUUUCACCUC | |
| AD-649370 | usasaaagCfaGfuGfUfuuuccaccucaL96 | | usGfsagg(Tgn)gaaaacaCfuGfcuuuasgsu | | ACUAAAGCAGUGUUUUCACCUCA | |
| AD-649371 | asasagcaGfuGfUfUfuuccaccucauL96 | | asUfsgagGf(Tgn)gaaaaacAfcUfgcuuusasg | | CUAAAGCAGUGUUUUCACCUCAU | |
| AD-649372 | asasgcagUfgUfUfUfucaccucauaL96 | | usAfsugaGfg(Tgn)gaaaaCaCfaCfugcuususa | | UAAAGCAGUGUUUUCACCUCAUA | |
| AD-649373 | aggscaguGfuUfUfUfcaccucauauL96 | | asUfsaug(Agn)ggugaaaAfcAfcugcususu | | AAAGCAGUGUUUUCACCUCAUAU | |
| AD-649374 | aggsaagucCfcAfGfGfcagagacaauL96 | | asUfsuguCf(Tgn)cugccuGfgAfcuucusasa | | UUAGAAGUCCAGGCAGAGACAAU | |
| AD-649375 | gsasagucCfaGfGfCfagagacaauaL96 | | asUfsguCf(Cgn)ucugccUfgGfacuucsusa | | UAGAAGUCCAGGCAGAGACAAUA | |
| AD-649376 | asasguccAfgGfCfAfgagacaauaaL96 | | usUfsauuGf(Tgn)cucugcCfuGfgacuuscsu | | AGAAGUCCAGGCAGAGACAAUAA | |
| AD-649377 | aggsuccaGfgCfAfGfAfgacaauaaaL96 | | usUfsuau(Tgn)gucucugCfcUfggacususe | | GAAGUCCAGGCAGAGACAAUAAA | |
| AD-649378 | gsusccagGfcAfGfAfgacaauaaaaL96 | | usUfsuuaUf(Tgn)gucucuGfcCfuggaesusu | | AAGUCCAGGCAGAGACAAUAAAA | |
| AD-649379 | uscsccagCfaGfAfGfacaauaaaauL96 | | asUfsuuuAf(Tgn)ugucucUfgCfcuggasesu | | AGUCCAGGCAGAGACAAUAAAAC | |

TABLE 3-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-649380 | cscsaggcAfgAfGfAfcaauaaaacaL96 | | usGfsuuuUf(Agn)uugucuCfuGfccugsasc | | GUCCAGGCAGAGACAAUAAAACA | |
| AD-649381 | csasggcagGfaGfAfCfaauaaaacauL96 | | asUfsguuUf(Tgn)auugucUfcUfgccugsgsa | | UCCAGGCAGAGACAAUAAAACAU | |
| AD-649382 | aggsgcagAfgAfCfAfAfauaaaacauuL96 | | asAfsuguUf(Tgn)uauugcCfuCfugccusgsg | | CCAGGCAGAGACAAUAAAACAUU | |
| AD-649383 | gsgscagaGfaCfAfAfAfuaaaacauuuL96 | | asAfsaugUf(Tgn)uuauugUfcUfcugcesusg | | CAGGCAGAGACAAUAAAACAUUC | |
| AD-649384 | gcsesagaGfcAfCfAfAfaaacauuccuL96 | | asGfsaauGf(Tgn)uuuauuGfcUfucugescsu | | AGGCAGAGACAAUAAAACAUUCC | |
| AD-649385 | aggsagaCfAfaTfAfAfaaacauuccuuL96 | | asAfsggaAf(Tgn)guuuuaUfuGfucucusgsc | | GCAGAGACAAUAAAACAUUCCUG | |
| AD-649386 | gbasgacaAfaAfAfAfacauuccuguL96 | | asCfsaggAf(Agn)uguuuuAfuUfgucucsusg | | CAGAGACAAUAAAACAUUCCUGU | |
| AD-649388 | gsascaauaAfaAfAfCfauuccugugaL96 | | usCfsacaGfg(Agn)auguuUfuUfauugucsusc | | GAGACAAUAAAACAUUCCUGUGA | |
| AD-649389 | ascsaauaAfaAfCfCfauuccugugaL96 | | usUfsucac(Agn)ggaauguUfuUfauugusesu | | AGACAAUAAAACAUUCCUGUGAA | |
| AD-649390 | csasauaAfaCfAfUfuccugugaaaL96 | | usUfsucaCf(Agn)ggaaugUfuUfuauugsusc | | GACAAUAAAACAUUCCUGUGAAA | |
| AD-649391 | asasuaaAfcAfUfUfccugugaaagL96 | | usUfsuucAf(Cgn)aggaauGfuUfuuausgsu | | ACAAUAAAACAUUCCUGUGAAAG | |
| AD-649392 | asusaaaCfaUfUfCfccugugaaaguL96 | | asCfsuuuCf(Agn)caggaaUfgUfuuuaususg | | CAAUAAAACAUUCCUGUGAAAGG | |
| AD-649394 | asasaacaUfcCfUfCfugugaaggcaL96 | | usGfsccuUf(Tgn)cacaggAfaUfguuususasu | | AUAAAACAUUCCUGUGAAAGGCA | |
| AD-649395 | asasacauUfcCfUfGfugaaaggcauL96 | | asUfsgcCfUf(Tgn)ucacagAfaUfguuususa | | UAAAACAUUCCUGUGAAAGGCAC | |
| AD-649396 | asascauUfcCfUfGfUfgaaaggcacuL96 | | asGfsugCf(Tgn)uucacaGfaAfaugususu | | AAAACAUUCCUGUGAAAGGCACU | |
| AD-649397 | ascsauuccCfuGfUfGfaaaggcacuuL96 | | asAfsgugCf(Cgn)uuucacAfgGfaauguSUsu | | AAACAUUCCUGUGAAAGGCACUU | |

TABLE 3-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-649398 | csasuuccUfgUfGfAfaaggcacuuuL96 | | asAfsaguGf(Cgn)cuuucaCfaGfgaaugsusu | | AACAUCCUGAAAGGCACUUU | |
| AD-649399 | asusuccuGfuGfAfAfaggcacuuuuL96 | | asAfsaag(Tgn)gccuuucAfcAfggaausgsu | | ACAUCCUGUGAAAGGCACUUUU | |
| AD-649400 | ususccugUfgAfAfAfggcacuuuuL96 | | asAfsaaaGf(Tgn)gccuuuCfaCfaggaasusg | | CAUUCCUGUGAAAGGCACUUUUC | |
| AD-649401 | uscscuguGfaAfAfGfgcacuuuucaL96 | | usGfsaaa(Agn)gugccuuUfcAfcaggasasu | | AUUCCUGUGAAAGGCACUUUUCA | |
| AD-649402 | cscsugugAfaAfGfGfcacuuuuucauL96 | | asUfsgaaAf(Agn)gugccuUfuCfacaggsasa | | UUCCUGUGAAAGGCACUUUUCAU | |
| AD-649403 | csusgugaAfaGfGfCfacuuuucauuL96 | | asAfsugaAf(Agn)agugccUfuUfcacagsgsa | | UCCUGUGAAAGGCACUUUUCAUU | |
| AD-649404 | usgsugaaAfgGfCfAfcuuuucauucL96 | | asAfsaugAf(Agn)aagugCfcUfuucaasgsg | | CCUGUGAAAGGCACUUUUCAUUC | |
| AD-649405 | gsusgaaAfgGfcAfCfuuuucauucuL96 | | asGfsaauGf(Agn)aaagugCfcUfuucacsasg | | CUGUGAAAGGCACUUUUCAUUCC | |
| AD-649406 | usgsaaagGfcAfCfUfUfuuucauucaL96 | | usGfsgaa(Tgn)gaaaaguGfcCfuuucascsa | | UGUGAAAGGCACUUUUCAUUCCA | |
| AD-649407 | gsasaaggCfaCfUfUfuucauuccauL96 | | asUfsggaAf(Tgn)gaaaagUfgCfcuuucsasc | | GUGAAAGGCACUUUUCAUUCCAC | |
| AD-68315 | usgsuaaccCfaAfGfAfguauuccauuL96 | | asAfsuggAfauacucuUfgGfuuacasausg | | CAUGUAACCAAGAGUAUUCCAUU | |

TABLE 3-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-68316 | asasccaagGfaGfUfAfuuccauuuuuL96 | | asAfsaaaUfggaauacUfcUfugguusasc | | GUAACCAAGAGUAUUCCAUUUUU | |
| AD-68317 | csasgagaCfaAfUfAfaaacauuccuL96 | | asGfsgaaUfguuuuauUfgUfcucugscs c | | GGCAGAGACAAUAAAACAUUCCU | |
| AD-68318 | ususuuuaCfuAfUfAfAfgcaguguuuuL96 | | asAfsaacAfcugcuuuAfgUfaaaasusg | | CAUUUUACUAAAGCAGUGUUUU | |
| AD-68326 | ususucauGfuAfUfAfCfcaagaguauuL96 | | asAfsuacUfcuugguuAfcAfugaaasus c | | GAUUUCAUGUACCAAGAGUAUU | |
| AD-68327 | csasauaaAfaCfAfUfuccugugaaaL96 | | usUfsucaCfaggaaugUfuUfuauugsus c | | GACAAUAAACAUUCCUGUGAAA | |
| AD-157442.5 | asasccaagGfaGfUfAfuuccauuuuuL96 | | asAfsaaa(Tgn)ggaauacUfcUfugguus asc | | GUAACCAAGAGUAUUCCAUUUUU | |
| AD-157470.8 | csasgagaCfaAfUfUfAfaaacauuccuL96 | | asGfsgaa(Tgn)guuuuauUfgUfcucug scsc | | GGCAGAGACAAUAAAACAUUCCU | |
| AD-65480 | usgsggauUfuCfAfUfguaaccaagaL96 | | usCfsuugGfuuacaugAfaAfucccasusc | | GAUGGGAUUCAUGUAACCAAGA | |

TABLE 4

Single Dose In Vitro Screens in Primary Cynomolgous Hepatocytes

| Duplex Name | 10 nM | Std Dev | 1 nM | Std Dev | 0.1 nM | Std Dev |
|---|---|---|---|---|---|---|
| AD-649237 | 9.9 | 1.6 | 27.7 | 4.0 | 72.9 | 8.7 |
| AD-649238 | 87.0 | 6.6 | 86.2 | 5.7 | 96.6 | 5.9 |
| AD-649239 | 14.1 | 2.9 | 18.6 | 3.2 | 69.7 | 8.5 |
| AD-649240 | 4.5 | 0.9 | 9.6 | 3.9 | 35.7 | 6.3 |
| AD-649241 | 8.5 | 3.9 | 14.8 | 1.3 | 52.8 | 6.1 |
| AD-649242 | 27.1 | 3.7 | 21.3 | 2.3 | 49.4 | 5.6 |
| AD-649243 | 8.6 | 1.8 | 11.3 | 1.4 | 38.9 | 4.6 |
| AD-649244 | 5.5 | 2.0 | 15.5 | 1.0 | 63.6 | 14.2 |
| AD-649245 | 7.5 | 1.1 | 23.1 | 6.0 | 68.6 | 6.6 |
| AD-649246 | 2.7 | 0.5 | 6.4 | 2.3 | 28.7 | 6.1 |
| AD-649247 | 3.2 | 0.6 | 7.7 | 3.0 | 38.1 | 5.7 |
| AD-649248 | 9.2 | 1.9 | 36.9 | 4.4 | 88.3 | 7.4 |
| AD-649249 | 11.1 | 2.0 | 42.2 | 2.9 | 93.0 | 8.3 |
| AD-649250 | 3.3 | 0.3 | 8.7 | 2.5 | 38.0 | 3.3 |
| AD-649251 | 1.4 | 0.4 | 1.8 | 0.6 | 12.8 | 2.7 |
| AD-65480 | 4.0 | 1.9 | 11.1 | 2.2 | 39.4 | 6.2 |
| AD-649252 | 10.2 | 3.1 | 30.2 | 5.9 | 70.5 | 8.6 |
| AD-649253 | 9.9 | 3.3 | 27.9 | 1.5 | 68.9 | 9.3 |
| AD-649254 | 5.9 | 1.5 | 19.2 | 5.6 | 59.5 | 11.5 |
| AD-649255 | 1.6 | 0.5 | 6.9 | 1.5 | 31.9 | 2.4 |
| AD-68326 | 2.3 | 0.5 | 8.2 | 1.9 | 35.1 | 9.8 |
| AD-649256 | 1.6 | 0.8 | 3.5 | 0.6 | 17.4 | 4.7 |
| AD-649258 | 3.0 | 0.8 | 7.1 | 1.8 | 34.6 | 21.0 |
| AD-649259 | 4.9 | 1.3 | 6.0 | 1.1 | 21.8 | 3.8 |
| AD-68315 | 1.0 | 0.6 | 2.7 | 0.7 | 13.6 | 5.2 |
| AD-649260 | 1.3 | 0.7 | 2.7 | 0.9 | 14.4 | 2.9 |
| AD-649261 | 2.6 | 0.5 | 5.5 | 1.5 | 25.3 | 3.9 |
| AD-68316 | 1.1 | 0.2 | 4.5 | 3.6 | 14.9 | 2.9 |
| AD-649262 | 1.4 | 0.5 | 3.9 | 1.7 | 22.1 | 5.6 |
| AD-649263 | 0.9 | 0.4 | 3.1 | 0.5 | 19.6 | 3.4 |
| AD-649264 | 2.4 | 2.1 | 4.5 | 2.2 | 15.7 | 4.9 |
| AD-649265 | 1.1 | 0.3 | 5.9 | 2.2 | 19.6 | 9.5 |
| AD-649266 | 0.8 | 0.5 | 1.7 | 0.5 | 12.2 | 1.6 |
| AD-649267 | 0.8 | 0.3 | 2.2 | 0.7 | 8.4 | 2.9 |
| AD-649268 | 1.5 | 0.7 | 3.6 | 0.9 | 20.3 | 6.5 |
| AD-649269 | 3.6 | 0.8 | 21.2 | 6.9 | 63.2 | 8.3 |
| AD-649270 | 6.4 | 0.9 | 22.6 | 4.0 | 68.2 | 6.9 |
| AD-649271 | 4.0 | 0.7 | 12.2 | 1.6 | 48.4 | 6.3 |
| AD-649272 | 5.4 | 4.8 | 10.2 | 2.8 | 45.7 | 15.6 |
| AD-649274 | 5.1 | 1.7 | 32.7 | 3.4 | 89.1 | 12.4 |
| AD-649275 | 3.4 | 1.2 | 10.8 | 2.4 | 46.3 | 10.2 |
| AD-649276 | 4.2 | 0.9 | 8.2 | 1.2 | 35.6 | 2.9 |
| AD-68318 | 1.1 | 0.6 | 6.4 | 0.7 | 20.1 | 6.4 |
| AD-649277 | 4.4 | 0.5 | 7.3 | 0.9 | 33.7 | 5.8 |
| AD-649278 | 2.2 | 0.7 | 4.8 | 0.9 | 27.0 | 8.2 |
| AD-649279 | 1.2 | 0.1 | 3.4 | 0.6 | 17.3 | 3.6 |
| AD-649280 | 0.9 | 0.3 | 2.9 | 0.4 | 17.7 | 4.7 |
| AD-649281 | 4.4 | 0.8 | 22.4 | 1.4 | 64.2 | 11.6 |
| AD-649282 | 2.0 | 0.8 | 5.6 | 0.9 | 27.8 | 9.3 |
| AD-649283 | 2.3 | 0.7 | 12.3 | 1.7 | 44.3 | 8.3 |
| AD-649284 | 2.0 | 2.1 | 2.8 | 0.7 | 18.6 | 3.4 |
| AD-649285 | 1.2 | 0.5 | 2.9 | 0.4 | 12.8 | 1.7 |
| AD-649286 | 1.6 | 0.4 | 3.2 | 1.1 | 17.5 | 7.6 |
| AD-649287 | 47.2 | 8.2 | 20.9 | 3.2 | 47.3 | 13.1 |
| AD-649288 | 5.7 | 2.2 | 10.2 | 1.4 | 36.8 | 7.7 |
| AD-649290 | 9.5 | 0.9 | 10.8 | 0.8 | 39.1 | 9.7 |
| AD-649291 | 7.7 | 1.7 | 8.6 | 0.3 | 32.4 | 5.1 |
| AD-649292 | 2.4 | 0.6 | 6.2 | 0.6 | 25.9 | 3.0 |
| AD-649293 | 4.4 | 1.0 | 13.9 | 2.4 | 51.9 | 9.0 |
| AD-649294 | 1.8 | 0.5 | 4.2 | 0.7 | 29.0 | 12.5 |
| AD-649295 | 6.8 | 1.2 | 8.5 | 1.4 | 29.5 | 4.4 |
| AD-649296 | 2.8 | 0.8 | 9.8 | 2.1 | 35.1 | 3.2 |
| AD-649297 | 17.4 | 1.9 | 29.4 | 5.6 | 61.7 | 10.8 |
| AD-68317 | 6.3 | 2.9 | 17.0 | 3.9 | 58.4 | 3.5 |
| AD-649298 | 3.7 | 3.0 | 7.7 | 1.7 | 33.4 | 8.2 |
| AD-649299 | 4.7 | 1.2 | 23.1 | 4.1 | 59.0 | 15.5 |
| AD-649300 | 4.9 | 1.4 | 15.5 | 5.3 | 48.7 | 9.7 |
| AD-649301 | 15.2 | 4.8 | 45.5 | 12.7 | 94.9 | 22.2 |
| AD-649302 | 6.5 | 0.3 | 21.1 | 3.7 | 67.4 | 4.6 |
| AD-68327 | 2.3 | 0.7 | 7.4 | 1.0 | 23.9 | 2.5 |
| AD-649303 | 44.1 | 8.6 | 28.0 | 4.1 | 69.5 | 8.6 |
| AD-649304 | 4.6 | 1.7 | 25.6 | 3.3 | 65.0 | 14.7 |
| AD-649305 | 22.5 | 3.3 | 55.8 | 6.2 | 100.1 | 3.5 |
| AD-649306 | 52.2 | 6.3 | 79.4 | 8.9 | 106.9 | 2.7 |
| AD-649307 | 13.5 | 1.0 | 18.8 | 2.6 | 56.4 | 5.6 |
| AD-649308 | 62.6 | 13.6 | 71.6 | 20.1 | 118.9 | 36.5 |
| AD-649309 | 50.2 | 4.3 | 62.2 | 6.3 | 82.1 | 6.9 |
| AD-649310 | 70.0 | 5.5 | 76.9 | 7.0 | 95.0 | 5.0 |
| AD-649311 | 83.6 | 3.3 | 78.4 | 6.0 | 99.3 | 5.2 |
| AD-649312 | 89.1 | 5.8 | 90.0 | 7.0 | 98.9 | 2.2 |
| AD-649313 | 91.8 | 2.4 | 91.7 | 10.4 | 102.8 | 5.3 |
| AD-649314 | 93.6 | 7.1 | 90.4 | 13.7 | 105.7 | 5.6 |
| AD-649315 | 88.2 | 3.0 | 78.5 | 8.0 | 93.5 | 8.0 |
| AD-649316 | 101.9 | 14.2 | 82.0 | 2.9 | 92.0 | 13.9 |
| AD-649318 | 86.1 | 3.0 | 88.5 | 7.3 | 85.6 | 1.4 |
| AD-649319 | 89.8 | 5.0 | 86.3 | 5.4 | 90.8 | 9.9 |

Example 3. Structure Activity Relationship (SAR) of dsRNA Agents of Interest

The structure activity relationships of dsRNA agents of interest identified in Example 2 were performed. Agents were designed and synthesized as described in Example 1. Single dose screens, in Hep3B cells, were performed as described in Example 2.

The unmodified nucleotide sequences of the agents in this example are shown in Table 5. The modified nucleotide sequences of the agents in this example are shown in Table 6. The results of the single dose screen are provided in Table 7.

TABLE 5

Unmodified Sense and Antisense Strand Sequences of TTR dsRNA Agents

| Duplex Name | Sense Sequence 5' to 3' | SEQ ID NO: | Antisense Sequence 5' to 3' | SEQ ID NO: |
|---|---|---|---|---|
| AD-649263.3 | CCAAGAGUAUUCCAUUUUUAU | | AUAAAAAUGGAAUACUCUUGGUU | |
| AD-1134924.1 | CCAAGAGUAUUCCAUUUUUAU | | AUAAAAAUGGAAUACUCUUGGUU | |
| AD-1134925.1 | CCAAGAGUAUUCCAUUUUUAU | | AUAAAAAUGGAAUACUCUUGGUU | |
| AD-1134926.1 | CCAAGAGUAUUCCAUUUUUAU | | AUAAAAAUGGAAUACUCUUGGUU | |
| AD-1134927.1 | CCAAGAGUAUUCCAUUUUUAU | | AUAAAAAUGGAAUACUCUUGGUU | |

TABLE 5-continued

Unmodified Sense and Antisense Strand
Sequences of TTR dsRNA Agents

| Duplex Name | Sense Sequence 5' to 3' | SEQ ID NO: | Antisense Sequence 5' to 3' | SEQ ID NO: |
|---|---|---|---|---|
| AD-1134928.1 | CCAAGAGUAUUCCAUUUUUAU | | AUAAAAAUGGAAUACUCUUGGUU | |
| AD-1134929.1 | CCAAGAGUAUUCCAUUUUUAU | | AUAAAAAUGGAAUACUCUUGGUU | |
| AD-1134930.1 | CCAAGAGUAUUCCAUUUUUAU | | AUAAAAAUGGAAUACUCUUGGUU | |
| AD-1134931.1 | CCAAGAGUAUUCCAUUUUUAU | | AUAAAAAUGGAAUACUCUUGGUU | |
| AD-1134932.1 | CCAAGAGUAUUCCAUUUUUAU | | AUAAAAAUGGAAUACUCUUGGUU | |
| AD-1134933.1 | CCAAGAGUAUUCCAUUUUUAU | | AUAAAAAUGGAAUACUCUUGGUU | |
| AD-1134934.1 | CCAAGAGUAUUCCAUUUUUAU | | AUAAAAAUGGAAUACUCUUGGUU | |
| AD-1134935.1 | CCAAGAGUAUUCCAUUUUUAU | | AUAAAAAUGGAAUACUCUUGGCC | |
| AD-1134936.1 | AAGAGUAUUCCAUUUUUAU | | AUAAAAAUGGAAUACUCUUGG | |
| AD-1134937.1 | CCAAGAGUAUUCCAUUUUUAU | | AUAAAAAUGGAAUACUCUUGGCC | |
| AD-1134938.1 | AAGAGUAUUCCAUUUUUAU | | AUAAAAAUGGAAUACUCUUGG | |
| AD-1134939.1 | CCAAGAGUAUUCCAUUUUUAU | | AUAAAAAUGGAAUACUCUUGGCC | |
| AD-1134940.1 | AAGAGUAUUCCAUUUUUAU | | AUAAAAAUGGAAUACUCUUGG | |
| AD-1134941.1 | CCAAGAGUAUUCCAUUUUUAU | | AUAAAAAUGGAAUACUCUUGGCC | |
| AD-1134942.1 | AAGAGUAUUCCAUUUUUAU | | AUAAAAAUGGAAUACUCUUGG | |
| AD-1134943.1 | CCAAGAGUAUUCCAUUUUUAU | | AUAAAAAUGGAAUACUCUUGGCC | |
| AD-1134944.1 | AAGAGUAUUCCAUUUUUAU | | AUAAAAAUGGAAUACUCUUGG | |
| AD-1134945.1 | CCAAGAGUAUUCCAUUUUUAU | | AUAAAAAUGGAAUACUCUUGGCC | |
| AD-1134946.1 | AAGAGUAUUCCAUUUUUAU | | AUAAAAAUGGAAUACUCUUGG | |
| AD-1134947.1 | CCAAGAGUAUUCCAUUUUUAU | | AUAAAAAUGGAAUACUCUUGGCC | |
| AD-1134948.1 | AAGAGUAUUCCAUUUUUAU | | AUAAAAAUGGAAUACUCUUGG | |
| AD-649264.3 | CAAGAGUAUUCCAUUUUUACU | | AGUAAAAAUGGAAUACUCUUGGU | |
| AD-1134949.1 | CAAGAGUAUUCCAUUUUUACU | | AGUAAAAAUGGAAUACUCUUGGU | |
| AD-1134950.1 | CAAGAGUAUUCCAUUUUUACU | | AGUAAAAAUGGAAUACUCUUGGU | |
| AD-1134951.1 | CAAGAGUAUUCCAUUUUUACU | | AGUAAAAAUGGAAUACUCUUGGU | |
| AD-1134952.1 | CAAGAGUAUUCCAUUUUUACU | | AGUAAAAAUGGAAUACUCUUGGU | |
| AD-1134953.1 | CAAGAGTAUUCCAUUUUUACU | | AGUAAAAAUGGAAUACUCUUGGU | |
| AD-1134954.1 | CAAGAGUAUUCCAUUUUUACU | | AGUAAAAAUGGAAUACUCUUGCC | |
| AD-1134955.1 | AGAGUAUUCCAUUUUUACU | | AGUAAAAAUGGAAUACUCUUG | |
| AD-1134956.1 | CAAGAGUAUUCCAUUUUUACU | | AGUAAAAAUGGAATACUCUUGGU | |
| AD-1134957.1 | CAAGAGUAUUCCAUUUUUACU | | AGUAAAAAUGGAAUACUCUUGGU | |
| AD-1134958.1 | CAAGAGTAUUCCAUUUUUACU | | AGUAAAAAUGGAAUACUCUUGGU | |
| AD-1134959.1 | CAAGAGUAUUCCAUUUUUACU | | AGUAAAAAUGGAAUACUCUUGGU | |
| AD-1134960.1 | CAAGAGTAUUCCAUUUUUACU | | AGUAAAAAUGGAAUACUCUUGGU | |
| AD-1134961.1 | CAAGAGUAUUCCAUUUUUACU | | AGUAAAAAUGGAAUACUCUUGCC | |
| AD-1134962.1 | AGAGUAUUCCAUUUUUACU | | AGUAAAAAUGGAAUACUCUUG | |
| AD-1134963.1 | CAAGAGUAUUCCAUUUUUACU | | AGUAAAAAUGGAAUACUCUUGCC | |

TABLE 5-continued

Unmodified Sense and Antisense Strand Sequences of TTR dsRNA Agents

| Duplex Name | Sense Sequence 5' to 3' | SEQ ID NO: | Antisense Sequence 5' to 3' | SEQ ID NO: |
|---|---|---|---|---|
| AD-1134964.1 | AGAGUAUUCCAUUUUUACU | | AGUAAAAAUGGAAUACUCUUG | |
| AD-1134965.1 | CAAGAGTAUUCCAUUUUUACU | | AGUAAAAAUGGAAUACUCUUGCC | |
| AD-1134966.1 | AGAGTAUUCCAUUUUUACU | | AGUAAAAAUGGAAUACUCUUG | |
| AD-1134967.1 | CAAGAGUAUUCCAUUUUUACU | | AGUAAAAAUGGAAUACUCUUGCC | |
| AD-1134968.1 | AGAGUAUUCCAUUUUUACU | | AGUAAAAAUGGAAUACUCUUG | |
| AD-649352.3 | AGAGUAUUCCAUUUUUACUAA | | UUAGUAAAAAUGGAAUACUCUUG | |
| AD-1134969.1 | AGAGUAUUCCAUUUUUACUAA | | UUAGUAAAAAUGGAAUACUCUUG | |
| AD-1134970.1 | AGAGUAUUCCAUUUUUACUAU | | AUAGUAAAAAUGGAAUACUCUUG | |
| AD-1134971.1 | AGAGUAUUCCAUUUUUACUAA | | UUAGTAAAAAUGGAAUACUCUUG | |
| AD-1134972.1 | AGAGUAUUCCAUUUUUACUAA | | UUAGUAAAAAUGGAAUACUCUUG | |
| AD-1134973.1 | AGAGUAUUCCAUUUUUACUAA | | UUAGTAAAAAUGGAAUACUCUUG | |
| AD-1134974.1 | AGAGUAUUCCAUUUUUACUAA | | UUAGUAAAAAUGGAAUACUCUUG | |
| AD-1134975.1 | AGAGUAUUCCAUUUUUACUAA | | UUAGUAAAAAUGGAAUACUCUCC | |
| AD-1134976.1 | AGUAUUCCAUUUUUACUAA | | UUAGUAAAAAUGGAAUACUCU | |
| AD-1134977.1 | AGAGUAUUCCAUUUUUACUAU | | AUAGTAAAAAUGGAAUACUCUUG | |
| AD-1134978.1 | AGAGUAUUCCAUUUUUACUAU | | AUAGTAAAAAUGGAAUACUCUUG | |
| AD-1134979.1 | AGAGUAUUCCAUUUUUACUAU | | AUAGTAAAAAUGGAAUACUCUUG | |
| AD-1134980.1 | AGAGUAUUCCAUUUUUACUAU | | AUAGTAAAAAUGGAAUACUCUUG | |
| AD-1134981.1 | AGAGUAUUCCAUUUUUACUAU | | AUAGTAAAAAUGGAAUACUCUUG | |
| AD-1134982.1 | AGAGUAUUCCAUUUUUACUAU | | AUAGTAAAAAUGGAAUACUCUUG | |
| AD-1134983.1 | AGAGUAUUCCAUUUUUACUAU | | AUAGTAAAAAUGGAAUACUCUUG | |
| AD-1134984.1 | AGAGUAUUCCAUUUUUACUAU | | AUAGTAAAAAUGGAAUACUCUUG | |
| AD-1134985.1 | AGAGUAUUCCAUUUUUACUAU | | AUAGTAAAAAUGGAAUACUCUUG | |
| AD-1134986.1 | AGAGUAUUCCAUUUUUACUAU | | AUAGTAAAAAUGGAAUACUCUUG | |
| AD-1134987.1 | AGAGUAUUCCAUUUUUACUAU | | AUAGTAAAAAUGGAAUACUCUUG | |
| AD-1134988.1 | AGAGUAUUCCAUUUUUACUAU | | AUAGTAAAAAUGGAAUACUCUUG | |
| AD-1134989.1 | AGAGUAUUCCAUUUUUACUAU | | AUAGTAAAAAUGGAAUACUCUCC | |
| AD-1134990.1 | AGAGUAUUCCAUUUUUACUAU | | AUAGTAAAAAUGGAAUACUCUCC | |
| AD-1134991.1 | AGAGUAUUCCAUUUUUACUAU | | AUAGTAAAAAUGGAAUACUCUCC | |
| AD-1134992.1 | AGAGUAUUCCAUUUUUACUAU | | AUAGTAAAAAUGGAAUACUCUCC | |
| AD-1134993.1 | AGUAUUCCAUUUUUACUAU | | AUAGTAAAAAUGGAAUACUCU | |
| AD-1134994.1 | AGUAUUCCAUUUUUACUAU | | AUAGTAAAAAUGGAAUACUCU | |
| AD-1134995.1 | AGUAUUCCAUUUUUACUAU | | AUAGTAAAAAUGGAAUACUCU | |
| AD-1134996.1 | AGUAUUCCAUUUUUACUAU | | AUAGTAAAAAUGGAAUACUCU | |
| AD-1134997.1 | AGAGUAUUCCAUUUUUACUAA | | UUAGUAAAAAUGGAAUACUCUUG | |
| AD-823016.4 | CUAAAGCAGUGUUUUCACCUA | | UAGGTGAAAACACUGCUUUAGUA | |
| AD-1134998.1 | CUAAAGCAGUGUUUUCACCUA | | UAGGTGAAAACACUGCUUUAGUA | |

TABLE 5-continued

Unmodified Sense and Antisense Strand Sequences of TTR dsRNA Agents

| Duplex Name | Sense Sequence 5' to 3' | SEQ ID NO: | Antisense Sequence 5' to 3' | SEQ ID NO: |
|---|---|---|---|---|
| AD-1134999.1 | CUAAAGCAGUGUUUUCACCUA | | UAGGTGAAAACACUGCUUUAGUA | |
| AD-1135000.1 | CUAAAGCAGUGUUUUCACCUU | | AAGGTGAAAACACUGCUUUAGUA | |
| AD-1135001.1 | CUAAAGCAGUGUUUUCACCUA | | UAGGTGAAAACACUGCUUUAGUA | |
| AD-1135002.1 | CUAAAGCAGUGUUUUCACCUA | | UAGGTGAAAACACUGCUUUAGCC | |
| AD-1135003.1 | AAAGCAGUGUUUUCACCUA | | UAGGTGAAAACACUGCUUUAG | |
| AD-1135004.1 | CUAAAGCAGUGUUUUCACCUA | | AAGGTGAAAACACUGCUUUAGUA | |
| AD-1135005.1 | CUAAAGCAGUGUUUUCACCUA | | AAGGTGAAAACACUGCUUUAGUA | |
| AD-1135006.1 | CUAAAGCAGUGUUUUCACCUA | | AAGGTGAAAACACUGCUUUAGCC | |
| AD-1135007.1 | CUAAAGCAGUGUUUUCACCUA | | AAGGTGAAAACACUGCUUUAGCC | |
| AD-1135008.1 | AAAGCAGUGUUUUCACCUA | | AAGGTGAAAACACUGCUUUAG | |
| AD-1135009.1 | AAAGCAGUGUUUUCACCUA | | AAGGTGAAAACACUGCUUUAG | |

TABLE 6

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-649263.3 | cscsaagaGfuAfUfUfccauuuuuauL96 | | asUfsaaaAfauggaauAfcUfcuuggsusu | | AACCAAGAGUAUUCCAUUUUUAC | |
| AD-1134924.1 | cscsaagaguAfUfUfccauuuuuauL96 | | asUfsaaaAfauggaauAfcUfcuuggsusu | | AACCAAGAGUAUUCCAUUUUUAC | |
| AD-1134925.1 | cscsaagadGuAfUfUfccauuuuuauL96 | | asUfsaaaAfauggaauAfcUfcuuggsusu | | AACCAAGAGUAUUCCAUUUUUAC | |
| AD-1134926.1 | cscsaagagudAUfUfccauuuuuauL96 | | asUfsaaaAfauggaauAfcUfcuuggsusu | | AACCAAGAGUAUUCCAUUUUUAC | |
| AD-1134927.1 | cscsaagadGudAUfUfccauuuuuauL96 | | asUfsaaaAfauggaauAfcUfcuuggsusu | | AACCAAGAGUAUUCCAUUUUUAC | |
| AD-1134928.1 | cscsaagaGfuAfUfUfccauuuuuauL96 | | asUfsaadAadAuggaauAfcUfcuuggsusu | | AACCAAGAGUAUUCCAUUUUUAC | |
| AD-1134929.1 | cscsaagaGfuAfUfUfccauuuuuauL96 | | asUfsaaaAfauggaaudAcUfcuuggsusu | | AACCAAGAGUAUUCCAUUUUUAC | |
| AD-1134930.1 | cscsaagaGfuAfUfUfccauuuuuauL96 | | asUfsaadAadAuggaaudAcUfcuuggsusu | | AACCAAGAGUAUUCCAUUUUUAC | |
| AD-1134931.1 | cscsaagaguAfUfUfccauuuuuauL96 | | asUfsaadAadAuggaauAfcUfcuuggsusu | | AACCAAGAGUAUUCCAUUUUUAC | |
| AD-1134932.1 | cscsaagadGuAfUfUfccauuuuuauL96 | | asUfsaadAadAuggaauAfcUfcuuggsusu | | AACCAAGAGUAUUCCAUUUUUAC | |
| AD-1134933.1 | cscsaagaguAfUfUfccauuuuuauL96 | | asUfsaadAadAuggaaudAcUfcuuggsusu | | AACCAAGAGUAUUCCAUUUUUAC | |
| AD-1134934.1 | cscsaagadGuAfUfUfccauuuuuauL96 | | asUfsaadAadAuggaaudAcUfcuuggsusu | | AACCAAGAGUAUUCCAUUUUUAC | |

TABLE 6-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1134935.1 | cscsaagaGfuAfUfUfccauuuuuauL96 | | asUfsaaaAfauggaauAfcUfcuuggscsc | | CCAAGAGUAUUCCAUUUUAC | |
| AD-1134936.1 | asasgaGfuAfUfUfccauuuuuauL96 | | asUfsaaaAfauggaauAfcUfcuusgsg | | AACCAAGAGUAUUCCAUUUUUAC | |
| AD-1134937.1 | cscsaagaguAfUfUfccauuuuuauL96 | | asUfsaadAadAuggaauAfcUfcuuggscsc | | CCAAGAGUAUUCCAUUUUAC | |
| AD-1134938.1 | asasgaguAfUfUfccauuuuuauL96 | | asUfsaadAadAuggaauAfcUfcuusgsg | | AACCAAGAGUAUUCCAUUUUUAC | |
| AD-1134939.1 | cscsaagadGuAfUfUfccauuuuuauL96 | | asUfsaadAadAuggaauAfcUfcuuggscsc | | CCAAGAGUAUUCCAUUUUAC | |
| AD-1134940.1 | asasgadGuAfUfUfccauuuuuauL96 | | asUfsaadAadAuggaauAfcUfcuusgsg | | AACCAAGAGUAUUCCAUUUUUAC | |
| AD-1134941.1 | cscsaagagudAUfUfccauuuuuauL96 | | asUfsaadAadAuggaauAfcUfcuuggscsc | | CCAAGAGUAUUCCAUUUUAC | |
| AD-1134942.1 | asasgagudAUfUfccauuuuuauL96 | | asUfsaadAadAuggaauAfcUfcuusgsg | | AACCAAGAGUAUUCCAUUUUUAC | |
| AD-1134943.1 | cscsaagadGudAUfUfccauuuuuauL96 | | asUfsaadAadAuggaauAfcUfcuuggscsc | | CCAAGAGUAUUCCAUUUUAC | |
| AD-1134944.1 | asasgadGudAUfUfccauuuuuauL96 | | asUfsaadAadAuggaauAfcUfcuusgsg | | AACCAAGAGUAUUCCAUUUUUAC | |
| AD-1134945.1 | cscsaagagudAUfUfccauuuuuauL96 | | asUfsaadAadAuggaaudAcUfcuuggscsc | | CCAAGAGUAUUCCAUUUUAC | |
| AD-1134946.1 | asasgagudAUfUfccauuuuuauL96 | | asUfsaadAadAuggaaudAcUfcuusgsg | | AACCAAGAGUAUUCCAUUUUUAC | |
| AD-1134947.1 | cscsaagadGudAUfUfccauuuuuauL96 | | asUfsaadAadAuggaaudAcUfcuuggscsc | | CCAAGAGUAUUCCAUUUUAC | |
| AD-1134948.1 | asasgadGudAUfUfccauuuuuauL96 | | asUfsaadAadAuggaaudAcUfcuusgsg | | AACCAAGAGUAUUCCAUUUUUAC | |
| AD-649264.3 | csasagagUfaUfUfCfcauuuuuacuL96 | | asGfsuaaAfaauggaaUfaCfucuugsgsu | | ACCAAGAGUAUUCCAUUUUACU | |
| AD-1134949.1 | csasagagUfaUfUfCfcauuuuuacuL96 | | asdGsuaaAfaauggaaUfaCfucuugsgsu | | ACCAAGAGUAUUCCAUUUUACU | |
| AD-1134950.1 | csasagagUfaUfUfCfcauuuuuacuL96 | | asGfsuadAadAauggaaUfaCfucuugsgsu | | ACCAAGAGUAUUCCAUUUUACU | |
| AD-1134951.1 | csasagagUfaUfUfCfcauuuuuacuL96 | | asdGsuadAadAauggaaUfaCfucuugsgsu | | ACCAAGAGUAUUCCAUUUUACU | |
| AD-1134952.1 | csasagaguaUfUfCfcauuuuuacuL96 | | asGfsuaaAfaauggaaUfaCfucuugsgsu | | ACCAAGAGUAUUCCAUUUUACU | |
| AD-1134953.1 | csasagagdTaUfUfCfcauuuuuacuL96 | | asGfsuaaAfaauggaaUfaCfucuugsgsu | | ACCAAGAGUAUUCCAUUUUACU | |
| AD-1134954.1 | csasagagUfaUfUfCfcauuuuuacuL96 | | asGfsuaaAfaauggaaUfaCfucuugscsc | | ACCAAGAGUAUUCCAUUUUACU | |
| AD-1134955.1 | asgsagUfaUfUfCfcauuuuuacuL96 | | asGfsuaaAfaauggaaUfaCfucususg | | CAAGAGUAUUCCAUUUUACU | |
| AD-1134956.1 | csasagaguaUfUfCfcauuuuuacuL96 | | asdGsuadAadAauggdAadTadCucuugsgsu | | ACCAAGAGUAUUCCAUUUUACU | |
| AD-1134957.1 | csasagaguaUfUfCfcauuuuuacuL96 | | asdGsuaaAfaauggaaUfaCfucuugsgsu | | ACCAAGAGUAUUCCAUUUUACU | |
| AD-1134958.1 | csasagagdTaUfUfCfcauuuuuacuL96 | | asdGsuaaAfaauggaaUfaCfucuugsgsu | | ACCAAGAGUAUUCCAUUUUACU | |

TABLE 6-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1134959.1 | csasagaguaUfUfCfcauuuuuuacuL96 | | asdGsuadAadAauggaaUfaCfucuugsgsu | | ACCAAGAGUAUUCCAUUUUUAC U | |
| AD-1134960.1 | csasagagdTaUfUfCfcauuuuuacuL96 | | asdGsuadAadAauggaaUfaCfucuugsgsu | | ACCAAGAGUAUUCCAUUUUUAC U | |
| AD-1134961.1 | csasagagUfaUfUfCfcauuuuuacuL96 | | asdGsuadAadAauggaaUfaCfucuugscsc | | ACCAAGAGUAUUCCAUUUUUAC U | |
| AD-1134962.1 | asgsagUfaUfUfCfcauuuuuacuL96 | | asdGsuadAadAauggaaUfaCfucususg | | CAAGAGUAUUCCAUUUUUACU | |
| AD-1134963.1 | csasagaguaUfUfCfcauuuuuuacuL96 | | asdGsuadAadAauggaaUfaCfucuugscsc | | ACCAAGAGUAUUCCAUUUUUAC U | |
| AD-1134964.1 | asgsaguaUfUfCfcauuuuuuacuL96 | | asdGsuadAadAauggaaUfaCfucususg | | CAAGAGUAUUCCAUUUUUACU | |
| AD-1134965.1 | csasagagdTaUfUfCfcauuuuuuacuL96 | | asdGsuadAadAauggaaUfaCfucuugscsc | | ACCAAGAGUAUUCCAUUUUUAC U | |
| AD-1134966.1 | asgsagdTaUfUfCfcauuuuuuacuL96 | | asdGsuadAadAauggaaUfaCfucususg | | CAAGAGUAUUCCAUUUUUACU | |
| AD-1134967.1 | csasagaguaUfUfCfcauuuuuuacuL96 | | asdGsuadAadAauggdAadTadCucuugscsc | | ACCAAGAGUAUUCCAUUUUUAC U | |
| AD-1134968.1 | asgsaguaUfUfCfcauuuuuuacuL96 | | asdGsuadAadAauggdAadTadCucususg | | CAAGAGUAUUCCAUUUUUACU | |
| AD-649352.3 | asgsaguaUfuCfCfAfuuuuuacuaaL96 | | usUfsaguAf(Agn)aaauggAfaUfacucususg | | CAAGAGUAUUCCAUUUUUACU AA | |
| AD-1134969.1 | asgsaguaUfuCfCfCfdAuuuuuacuaaL96 | | usUfsaguAf(Agn)aaauggAfaUfacucususg | | CAAGAGUAUUCCAUUUUUACU AA | |
| AD-1134970.1 | asgsaguaUfuCfCfcdAUfuuuuacuaaL96 | | usUfsaguAf(Agn)aaauggAfaUfacucususg | | CAAGAGUAUUCCAUUUUUACU AA | |
| AD-1134971.1 | asgsaguaUfuCfCfAfuuuuuacuauL96 | | asUfsaguAf(Agn)aaauggAfaUfacucususg | | CAAGAGUAUUCCAUUUUUACU AA | |
| AD-1134972.1 | asgsaguaUfuCfCfAfuuuuuacuaaL96 | | usUfsagdTa(Agn)aaauggAfaUfacucususg | | CAAGAGUAUUCCAUUUUUACU AA | |
| AD-1134973.1 | asgsaguaUfuCfCfAfuuuuuacuaaL96 | | usUfsaguAf(A2p)aaauggAfaUfacucususg | | CAAGAGUAUUCCAUUUUUACU AA | |
| AD-1134974.1 | asgsaguaUfuCfCfAfuuuuuacuaaL96 | | usUfsagdTa(A2p)aaauggAfaUfacucususg | | CAAGAGUAUUCCAUUUUUACU AA | |
| AD-1134975.1 | asgsaguaUfuCfCfAfuuuuuacuaaL96 | | usUfsaguAf(Agn)aaauggdAaUfacucususg | | CAAGAGUAUUCCAUUUUUACU AA | |
| AD-1134976.1 | asgsaguaUfuCfCfAfuuuuuacuaaL96 | | usUfsaguAf(Agn)aaauggAfaUfacucuscsc | | CAAGAGUAUUCCAUUUUUACU AA | |
| AD-1134977.1 | asgsuaUfuCfCfCfAfuuuuuacuaaL96 | | usUfsaguAf(Agn)aaauggAfaUfacuscsu | | AGAGUAUUCCAUUUUUACUAA | |
| AD-1134978.1 | asgsaguaUfuCfCfAfuuuuuuacuauL96 | | asUfsagdTa(Agn)aaauggAfaUfacucususg | | CAAGAGUAUUCCAUUUUUACU AA | |
| AD-1134979.1 | asgsaguaUfuCfCfAfuuuuuuacuauL96 | | asUfsagdTa(Agn)aaauggdAaUfacucususg | | CAAGAGUAUUCCAUUUUUACU AA | |
| AD-1134980.1 | asgsaguaUfuCfCfAfuuuuuuacuauL96 | | asUfsagdTa(A2p)aaauggAfaUfacucususg | | CAAGAGUAUUCCAUUUUUACU AA | |
| AD-1134981.1 | asgsaguaUfuCfCfAfuuuuuuacuauL96 | | asUfsagdTa(A2p)aaauggdAaUfacucususg | | CAAGAGUAUUCCAUUUUUACU AA | |

TABLE 6-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1134982.1 | asgsaguaUfuCfCfdAuuuuuacuauL96 | | asUfsagdTa(Agn)aaauggAfaUfacucususg | | CAAGAGUAUUCCAUUUUUACUAA | |
| AD-1134983.1 | asgsaguaUfuCfCfdAuuuuua9cuauL6 | | asUfsagdTa(Agn)aaauggdAaUfacucususg | | CAAGAGUAUUCCAUUUUUACUAA | |
| AD-1134984.1 | asgsaguaUfuCfCfdAuuuuuacuauL96 | | asUfsagdTa(A2p)aaauggAfaUfacucususg | | CAAGAGUAUUCCAUUUUUACUAA | |
| AD-1134985.1 | asgsaguaUfuCfCfdAuuuuuacuauL96 | | asUfsagdTa(A2p)aaauggdAaUfacucususg | | CAAGAGUAUUCCAUUUUUACUAA | |
| AD-1134986.1 | asgsaguaUfuCfcdAUfuuuuacuauL96 | | asUfsagdTa(Agn)aaauggAfaUfacucususg | | CAAGAGUAUUCCAUUUUUACUAA | |
| AD-1134987.1 | asgsaguaUfuCfcdAUfuuuuacuauL96 | | asUfsagdTa(Agn)aaauggdAaUfacucususg | | CAAGAGUAUUCCAUUUUUACUAA | |
| AD-1134988.1 | asgsaguaUfuCfcdAUfuuuuacuauL96 | | asUfsagdTa(A2p)aaauggAfaUfacucususg | | CAAGAGUAUUCCAUUUUUACUAA | |
| AD-1134989.1 | asgsaguaUfuCfcdAUfuuuuacuauL96 | | asUfsagdTa(A2p)aaauggdAaUfacucususg | | CAAGAGUAUUCCAUUUUUACUAA | |
| AD-1134990.1 | asgsaguaUfuCfCfdAuuuuuacuauL96 | | asUfsagdTa(Agn)aaauggAfaUfacucuscsc | | CAAGAGUAUUCCAUUUUUACUAA | |
| AD-1134991.1 | asgsaguaUfuCfCfdAuuuuuacuauL96 | | asUfsagdTa(Agn)aaauggdAaUfacucuscsc | | CAAGAGUAUUCCAUUUUUACUAA | |
| AD-1134992.1 | asgsaguaUfuCfCfdAuuuuuacuauL96 | | asUfsagdTa(A2p)aaauggAfaUfacucuscsc | | CAAGAGUAUUCCAUUUUUACUAA | |
| AD-1134993.1 | asgsaguaUfuCfCfdAuuuuuacuauL96 | | asUfsagdTa(A2p)aaauggdAaUfacucuscsc | | CAAGAGUAUUCCAUUUUUACUAA | |
| AD-1134994.1 | asgsuaUfuCfCfdAuuuuuacuauL96 | | asUfsagdTa(Agn)aaauggAfaUfacuscscu | | AGAGUAUUCCAUUUUUACUAA | |
| AD-1134995.1 | asgsuaUfuCfCfdAuuuuuacuauL96 | | asUfsagdTa(Agn)aaauggdAaUfacuscscu | | AGAGUAUUCCAUUUUUACUAA | |
| AD-1134996.1 | asgsuaUfuCfCfdAuuuuuacuauL96 | | asUfsagdTa(A2p)aaauggAfaUfacuscscu | | AGAGUAUUCCAUUUUUACUAA | |
| AD-1134997.1 | asgsuaUfuCfCfdAuuuuuacuauL96 | | asUfsagdTa(A2p)aaauggdAaUfacuscscu | | AGAGUAUUCCAUUUUUACUAA | |
| AD-823016.4 | csusaaagCfaGfUfGfuuuucaccuaL96 | | usAfsgggdTg(A2p)aaacacUfgCfuuuuagsusa | | UACUAAAGCAGUGUUUUCACCUC | |
| AD-1134998.1 | csusaaagCfagUfdGuuuucaccuaL96 | | usAfsgggdTg(A2p)aaacacUfgCfuuuuagsusa | | UACUAAAGCAGUGUUUUCACCUC | |
| AD-1134999.1 | csusaaagCfadGudGUfuuucaccuaL96 | | usAfsgggdTg(A2p)aaacacUfgCfuuuuagsusa | | UACUAAAGCAGUGUUUUCACCUC | |
| AD-1135000.1 | csusaaagCfaGfUfGfuuuucaccuuL96 | | asAfsgggdTg(A2p)aaacacUfgCfuuuuagsusa | | UACUAAAGCAGUGUUUUCACCUC | |
| AD-1135001.1 | csusaaagCfaGfUfGfuuuucaccuaL96 | | usdAsggdTg(A2p)aaacacUfgCfuuuuagsusa | | UACUAAAGCAGUGUUUUCACCUC | |
| AD-1135002.1 | csusaaagCfaGfUfGfuuuucaccuaL96 | | usAfsgggdTg(A2p)aaacacUfgCfuuuuagscsc | | UACUAAAGCAGUGUUUUCACCUC | |
| AD-1135003.1 | asasaagCfaGfUfGfuuuucaccuaL96 | | usAfsgggdTg(A2p)aaacacUfgCfuuusasg | | CUAAAGCAGUGUUUUCACCUC | |
| AD-1135004.1 | csusaaagCfagUfdGuuuucaccuaL96 | | asdAsggdTg(A2p)aaacacUfgCfuuuuagsusa | | UACUAAAGCAGUGUUUUCACCUC | |
| AD-1135005.1 | csusaaagCfadGudGUfuuucaccuaL96 | | asdAsggdTg(A2p)aaacacUfgCfuuuuagsusa | | UACUAAAGCAGUGUUUUCACCUC | |

TABLE 6-continued

Modified Sense and Antisense Strand Sequences of TTR dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1135006.1 | csusaaagCfagUfdGuuuuc accuaL96 | | asdAsggdTg(A2p)aaacacUfgCfuuuags csc | | UACUAAAGCAGUGUUUUCACCU C | |
| AD-1135007.1 | csusaaagCfadGudGUfuuu caccuaL96 | | asdAsggdTg(A2p)aaacacUfgCfuuuags csc | | UACUAAAGCAGUGUUUUCACCU C | |
| AD-1135008.1 | asasagCfagUfdGuuuuca ccuaL96 | | asdAsggdTg(A2p)aaacacUfgCfuuusas g | | CUAAAGCAGUGUUUUCACCUC | |
| AD-1135009.1 | asasagCfadGudGUfuuuca ccuaL96 | | asdAsggdTg(A2p)aaacacUfgCfuuusas g | | CUAAAGCAGUGUUUUCACCUC | |

TABLE 7

Single Dose In Vitro Screens in Hep3B Cells

| Duplex Name | 50 nM | STDEV | 10 nM | STDEV | 1 nM | STDEV | 0.1 nM | STDEV |
|---|---|---|---|---|---|---|---|---|
| AD-649263.3 | 3.59 | 0.88 | 2.58 | 0.54 | 3.39 | 1.09 | 20.52 | 6.80 |
| AD-1134924.1 | 3.51 | 1.42 | 3.92 | 1.91 | 3.71 | 0.96 | 19.87 | 4.64 |
| AD-1134925.1 | 4.05 | 2.40 | 3.05 | 1.08 | 4.14 | 2.53 | 12.92 | 3.98 |
| AD-1134926.1 | 4.50 | 1.35 | 3.34 | 1.23 | 5.55 | 1.89 | 16.21 | 6.50 |
| AD-1134927.1 | 3.59 | 1.19 | 3.73 | 0.31 | 5.13 | 1.98 | 14.40 | 2.57 |
| AD-1134928.1 | 2.56 | 0.69 | 2.91 | 0.49 | 3.47 | 0.51 | 11.03 | 3.20 |
| AD-1134929.1 | 3.37 | 1.82 | 3.17 | 0.87 | 4.80 | 1.24 | 16.19 | 2.50 |
| AD-1134930.1 | 1.49 | 0.39 | 2.08 | 0.62 | 3.53 | 1.23 | 7.57 | 2.29 |
| AD-1134931.1 | 3.62 | 1.19 | 3.97 | 1.54 | 3.18 | 1.65 | 21.57 | 6.92 |
| AD-1134932.1 | 5.82 | 0.79 | 5.16 | 1.62 | 6.94 | 1.25 | 21.26 | 5.08 |
| AD-1134933.1 | 3.59 | 1.05 | 4.11 | 1.12 | 4.99 | 1.37 | 22.04 | 6.24 |
| AD-1134934.1 | 5.43 | 2.04 | 4.00 | 0.68 | 7.60 | 1.66 | 30.92 | 12.34 |
| AD-1134935.1 | 3.42 | 1.76 | 3.95 | 0.35 | 7.74 | 1.70 | 27.25 | 9.69 |
| AD-1134936.1 | 2.40 | 1.13 | 3.80 | 0.59 | 5.33 | 2.39 | 16.94 | 5.51 |
| AD-1134937.1 | 2.51 | 0.82 | 3.36 | 0.73 | 6.37 | 1.93 | 21.05 | 9.05 |
| AD-1134938.1 | 1.17 | 0.50 | 3.26 | 0.90 | 3.04 | 0.58 | 7.20 | 2.40 |
| AD-1134939.1 | 2.86 | 0.77 | 3.01 | 1.13 | 3.30 | 0.44 | 15.87 | 2.88 |
| AD-1134940.1 | 4.44 | 2.00 | 3.07 | 0.67 | 6.62 | 4.33 | 21.03 | 1.48 |
| AD-1134941.1 | 4.28 | 2.31 | 3.91 | 0.32 | 7.30 | 2.83 | 25.80 | 3.90 |
| AD-1134942.1 | 2.72 | 1.50 | 4.69 | 1.12 | 4.05 | 1.47 | 18.32 | 7.37 |
| AD-1134943.1 | 1.77 | 0.64 | 4.12 | 1.01 | 6.19 | 2.72 | 20.18 | 9.77 |
| AD-1134944.1 | 1.85 | 1.49 | 3.01 | 0.77 | 5.35 | 2.37 | 15.78 | 5.59 |
| AD-1134945.1 | 1.75 | 0.35 | 3.64 | 1.82 | 9.89 | 9.93 | 19.27 | 13.11 |
| AD-1134946.1 | 4.15 | 0.57 | 4.52 | 1.18 | 5.21 | 0.76 | 21.71 | 9.03 |
| AD-1134947.1 | 3.12 | 1.73 | 5.81 | 1.13 | 14.51 | 1.78 | 37.70 | 5.89 |
| AD-1134948.1 | 2.66 | 1.03 | 3.99 | 0.78 | 8.53 | 2.73 | 19.97 | 3.13 |
| AD-649264.3 | 3.32 | 1.61 | 3.17 | 0.90 | 7.01 | 1.58 | 21.67 | 8.15 |
| AD-1134949.1 | 2.75 | 2.07 | 3.68 | 1.27 | 5.56 | 1.29 | 20.73 | 5.70 |
| AD-1134950.1 | 1.36 | 0.52 | 3.16 | 1.92 | 4.69 | 1.97 | 9.24 | 2.27 |
| AD-1134951.1 | 0.75 | 0.25 | 4.34 | 5.81 | 3.03 | 1.11 | 5.28 | 4.51 |
| AD-1134952.1 | 5.01 | 2.65 | 3.89 | 1.18 | 8.17 | 3.89 | 27.68 | 21.94 |
| AD-1134953.1 | 3.09 | 1.52 | 5.80 | 3.12 | 7.95 | 2.08 | 31.87 | 12.75 |
| AD-1134954.1 | 4.92 | 5.84 | 3.93 | 1.27 | 10.77 | 4.69 | 28.26 | 4.34 |
| AD-1134955.1 | 3.12 | 2.13 | 5.33 | 0.97 | 8.02 | 2.07 | 25.60 | 6.65 |
| AD-1134956.1 | 1.76 | 1.07 | 2.99 | 1.01 | 6.10 | 1.87 | 22.32 | 1.75 |
| AD-1134957.1 | 4.09 | 3.22 | 3.66 | 0.88 | 14.04 | 13.75 | 20.80 | 4.66 |
| AD-1134958.1 | 1.24 | 0.21 | 4.40 | 1.49 | 5.76 | 1.87 | 19.18 | 6.34 |
| AD-1134959.1 | 1.56 | 1.77 | 3.10 | 0.83 | 3.30 | 1.89 | 11.39 | 2.37 |
| AD-1134960.1 | 4.46 | 1.74 | 4.21 | 1.09 | 4.41 | 1.49 | 10.29 | 2.93 |
| AD-1134961.1 | 6.34 | 4.62 | 3.98 | 1.21 | 9.72 | 2.44 | 29.22 | 23.79 |
| AD-1134962.1 | 1.49 | 0.58 | 3.94 | 1.20 | 11.88 | 13.87 | 13.84 | 4.48 |
| AD-1134963.1 | 4.88 | 4.27 | 6.19 | 2.27 | 7.99 | 2.97 | 18.86 | 5.66 |
| AD-1134964.1 | 1.75 | 0.29 | 3.80 | 1.56 | 4.66 | 0.57 | 12.11 | 2.11 |
| AD-1134965.1 | 1.67 | 0.78 | 4.23 | 0.69 | 7.61 | 0.83 | 12.17 | 4.72 |
| AD-1134966.1 | 0.72 | 0.10 | 2.98 | 0.56 | 3.87 | 1.61 | 7.78 | 2.16 |
| AD-1134967.1 | 3.59 | 1.39 | 3.29 | 0.68 | 8.67 | 3.14 | 27.10 | 6.99 |
| AD-1134968.1 | 9.29 | 7.68 | 6.48 | 2.93 | 13.13 | 2.21 | 41.28 | 12.20 |
| AD-649352.3 | 2.22 | 1.19 | 4.53 | 1.38 | 12.49 | 2.22 | 33.30 | 9.49 |
| AD-1134969.1 | 3.79 | 1.67 | 5.69 | 1.38 | 10.04 | 1.51 | 34.14 | 8.78 |
| AD-1134970.1 | 1.92 | 1.03 | 2.92 | 0.39 | 6.29 | 0.67 | 16.78 | 4.95 |
| AD-1134971.1 | 1.47 | 0.50 | 3.85 | 1.21 | 6.99 | 0.82 | 20.25 | 7.51 |
| AD-1134972.1 | 2.25 | 1.10 | 5.17 | 1.48 | 8.78 | 4.43 | 26.72 | 7.62 |
| AD-1134973.1 | 1.21 | 0.53 | 2.52 | 0.92 | 3.90 | 1.39 | 15.91 | 6.51 |

TABLE 7-continued

Single Dose In Vitro Screens in Hep3B Cells

| Duplex Name | 50 nM | STDEV | 10 nM | STDEV | 1 nM | STDEV | 0.1 nM | STDEV |
|---|---|---|---|---|---|---|---|---|
| AD-1134974.1 | 2.42 | 0.92 | 3.02 | 0.73 | 10.75 | 6.21 | 21.16 | 10.37 |
| AD-1134975.1 | 5.56 | 1.44 | 8.79 | 0.90 | 25.39 | 9.89 | 73.20 | 17.49 |
| AD-1134976.1 | 4.01 | 2.02 | 7.02 | 1.49 | 16.12 | 6.64 | 46.99 | 4.67 |
| AD-1134977.1 | 5.25 | 4.03 | 6.17 | 1.49 | 13.32 | 6.43 | 45.95 | 8.58 |
| AD-1134978.1 | 1.83 | 1.20 | 3.51 | 1.22 | 8.02 | 2.02 | 17.91 | 5.45 |
| AD-1134979.1 | 6.07 | 2.30 | 8.15 | 3.14 | 24.69 | 8.69 | 57.44 | 17.16 |
| AD-1134980.1 | 2.94 | 3.56 | 4.06 | 1.43 | 9.34 | 3.28 | 19.86 | 6.30 |
| AD-1134981.1 | 0.74 | 0.30 | 5.03 | 0.15 | 7.73 | 1.62 | 27.87 | 7.17 |
| AD-1134982.1 | 2.37 | 0.78 | 3.49 | 1.13 | 5.78 | 1.54 | 24.37 | 3.31 |
| AD-1134983.1 | 5.24 | 3.02 | 8.60 | 2.50 | 35.63 | 9.34 | 63.89 | 6.64 |
| AD-1134984.1 | 6.05 | 5.00 | 4.90 | 0.52 | 12.73 | 2.26 | 38.25 | 7.70 |
| AD-1134985.1 | 2.43 | 2.21 | 3.48 | 1.02 | 14.21 | 2.58 | 30.15 | 7.15 |
| AD-1134986.1 | 1.49 | 0.91 | 3.43 | 1.86 | 11.10 | 5.13 | 21.03 | 4.22 |
| AD-1134987.1 | 4.15 | 4.14 | 5.05 | 4.00 | 21.23 | 5.09 | 41.67 | 13.56 |
| AD-1134988.1 | 3.00 | 3.94 | 2.82 | 1.77 | 8.27 | 3.58 | 19.12 | 9.53 |
| AD-1134989.1 | 2.85 | 1.52 | 3.17 | 1.04 | 10.05 | 5.24 | 36.81 | 12.84 |
| AD-1134990.1 | 7.61 | 4.89 | 9.07 | 2.32 | 34.61 | 10.58 | 63.48 | 7.99 |
| AD-1134991.1 | 50.22 | 19.64 | 49.12 | 6.25 | 101.71 | 17.49 | 136.51 | 23.16 |
| AD-1134992.1 | 2.41 | 0.93 | 3.45 | 1.46 | 15.51 | 6.88 | 31.13 | 8.62 |
| AD-1134993.1 | 7.95 | 3.63 | 11.19 | 1.82 | 41.88 | 9.00 | 77.13 | 21.75 |
| AD-1134994.1 | 2.39 | 1.08 | 6.06 | 1.49 | 18.85 | 0.59 | 43.13 | 18.95 |
| AD-1134995.1 | 11.15 | 5.70 | 23.39 | 2.85 | 47.27 | 10.06 | 85.90 | 29.94 |
| AD-1134996.1 | 0.71 | 0.24 | 2.29 | 0.53 | 4.15 | 1.38 | 20.18 | 2.40 |
| AD-1134997.1 | 7.40 | 2.06 | 13.11 | 9.24 | 46.61 | 12.33 | 98.20 | 30.88 |
| AD-823016.4 | 1.63 | 1.07 | 3.43 | 0.82 | 10.39 | 1.89 | 19.72 | 4.88 |
| AD-1134998.1 | 3.90 | 1.52 | 4.25 | 1.51 | 12.24 | 2.79 | 41.32 | 8.36 |
| AD-1134999.1 | 1.89 | 0.85 | 4.03 | 1.08 | 12.44 | 5.35 | 22.17 | 1.79 |
| AD-1135000.1 | 1.27 | 0.41 | 3.16 | 1.17 | 6.73 | 1.22 | 13.45 | 3.19 |
| AD-1135001.1 | 0.78 | 0.28 | 3.62 | 2.05 | 4.48 | 2.84 | 14.71 | 10.28 |
| AD-1135002.1 | 1.10 | 0.68 | 6.28 | 2.10 | 4.86 | 2.89 | 19.69 | 13.10 |
| AD-1135003.1 | 2.99 | 0.31 | 2.61 | 0.98 | 6.32 | 4.89 | 19.24 | 3.86 |
| AD-1135004.1 | 1.89 | 1.61 | 2.40 | 0.51 | 3.69 | 1.66 | 15.45 | 1.46 |
| AD-1135005.1 | 1.12 | 0.64 | 1.71 | 0.57 | 3.08 | 1.31 | 11.95 | 4.45 |
| AD-1135006.1 | 1.78 | 0.13 | 3.93 | 1.25 | 12.12 | 5.53 | 28.83 | 2.03 |
| AD-1135007.1 | 0.84 | 0.26 | 2.45 | 0.90 | 4.56 | 2.41 | 16.49 | 5.07 |
| AD-1135008.1 | 1.43 | 0.60 | 2.20 | 0.48 | 2.28 | 1.00 | 11.78 | 2.20 |
| AD-1135009.1 | 0.98 | 0.62 | 2.02 | 0.81 | 2.19 | 1.09 | 7.28 | 4.01 |

Example 4. In Vivo Screening of dsRNA Duplexes in Mice

Duplexes of interest, identified from the above in vitro studies, were evaluated in vivo. In particular, at pre-dose day −14 wild type mice (C57BL/6) were transduced by intravenous administration of $2\times10^{11}$ viral particles of an adeno-associated virus 8 (AAV8) vector encoding human TTR. In particular, mice were administered an AAV8 encoding human TTR.

At day 0, groups of three mice were subcutaneously administered a single 1 mg/kg dose of the agents of interest or PBS control. At day 7 post-dose animals were sacrificed, liver samples were collected and snap-frozen in liquid nitrogen. Tissue mRNA was extracted and analyzed by the RT-QPCR method.

Human TTR mRNA levels were compared to housekeeping gene GAPDH. The values were then normalized to the average of PBS vehicle control group. The data were expressed as percent of baseline value, and presented as mean plus standard deviation. The results, shown in FIG. 1, demonstrate that the exemplary duplex agents tested potently reduce the level of the human TTR messenger RNA in vivo.

Example 5. In Vivo Screening of dsRNA Duplexes in Cynomolgus Monkeys

Duplexes of interest, identified from the above mouse studies, were evaluated in cynomolgus monkey. Animals (N=3 per group) received a single 0.5 mg/kg subcutaneous dose of a dsRNA agent (AD-649263, AD-1134938, AD-649264, AD-1134966, or AD-65496) on day 1.

AD-65496, previously identified as a dsRNA agent that potently and durably inhibits human TTR mRNA and protein, was used as a comparator. The modified nucleotide sequence of the sense strand of AD-65496 is 5'-usgsggauU-fuCfAfUfguaaccaaga-3' (SEQ ID NO:1385) and the modified nucleotide sequence of the antisense strand of AD-65496 is 5'-VPusCfsuugGfuuAfcaugAfaAfucccasusc-3' (SEQ ID NO:1386).

Figure 2:
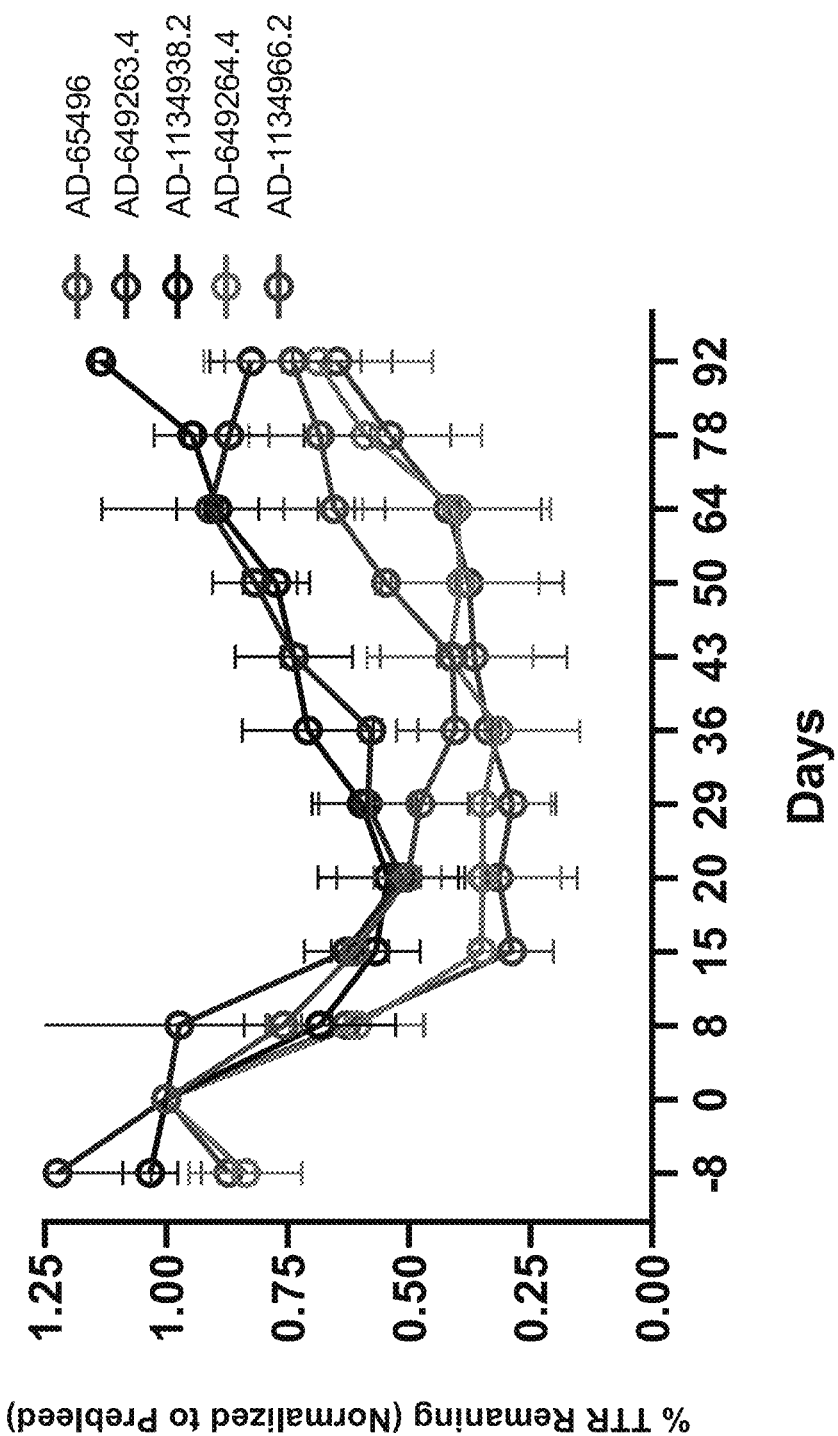
FIG. 2 is a graph showing the effect of administration of a single subcutaneous 0.5 mg/kg dose of AD-649263, AD-1134938 AD-649264, AD-1134966, or AD-65496 on TTR mRNA levels in non-human primates.

Blood was obtained on days −8, 0, 8, 15, 20, 29, 36, 43, 50, 64, 78, and 92 post-dose. TTR mRNA levels were determined as described above. Data were expressed as percent of baseline value, and presented as mean plus/minus standard deviation. The results are shown in FIG. 2.

The data demonstrate that subcutaneous administration of a single 0.5 mg/kg dose of AD-649263, AD-1134938, AD-649264, AD-1134966, or AD-65496 potently and durably inhibits TTR mRNA. The data also demonstrate that the knockdown of TTR mRNA following subcutaneous administration of a single 0.5 mg/kg dose of AD-1134966 or AD-649264 is similar to the knockdown and duration knockdown of TTR observed with the previously evaluated duplex, AD-65496. In addition, the data demonstrate that the knockdown of TTR mRNA following subcutaneous administration of a single 0.5 mg/kg dose of AD-1134938 or AD-1134966 is similar to the knockdown observed with each respective parent duplex (AD-649263 or AD-649264). The data also demonstrate that AD-649264 is more potent than AD-649263 in vivo, recapitulating the data obtained in the AAV experiments described in Example 4.

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (1386 sequences)

SEQ ID NO: 1 - DNA, 616 bp, Homo sapiens
  source 1..616: mol_type = genomic DNA
acagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggca

SEQ ID NO: 2 - DNA, 1050 bp, Mus musculus
  source 1..1050: mol_type = genomic DNA
acacagatccacaagctcctgacaggatggcttcccttcgactcttcctcctttgcctcgctggactggtatttgtgtctgaagctggccccgcgggtgctggagaatccaaatgtcctctgatggtcaaagtcctggatgctgtccgaggcagccctgctgtagacgtggctgtaaaagtgttcaaaaagacctctgagggatcctgggagccctttgcctctgggaagaccgcggagtctggagagctgcacgggctcaccacagatgagaagtttgtagaaggagtgtacagagtagaactggacaccaaatcgtactggaagacacttggcatttccccgttccatgaattcgcggatgtggttttcacagccaacgactctggccatcgccactacaccatcgcagccctgctcagcccatactcctacagcaccacggctgtcgtcagcaacccccagaattgagagactcagcccaggaggaccaggatcttgccaaagcagtagcatcccatttgtaccaaaacagtgttcttgctctataaaccgtgttagcagctcaggaagatgccgtgaagcattcttattaaaccacctgctatttcattcaaactgtgtttcttttttatttcctcatttttctcccctgctcctaaaacccaaaattttttaaagaattctagaaggtatgcgatcaaactttttaaagaaagaaaatactttttgactcatggtttaaaggcatcctttccatcttggggaggtcatgggtgctcctggcaacttgcttgaggaagataggtcagaaagcagagtggaccaaccgttcaatgttttacaagcaaaacatacactaacatggtctgtagctattaaaagcacacaatctgaagggctgtagatgcacagtagtgttttcccagagcatgttcaaaagccctgggttcaatcacaatactgaaaagtaggccaaaaaacattctgaaaatgaaatatttgggtttttttttataacctttagtgactaaataaagccaaatctagg

SEQ ID NO: 3 - DNA, 595 bp, Rattus norvegicus
  source 1..595: mol_type = genomic DNA
cctgacaggatggcttcccttcgcctgttcctcctctgcctcgctggactgatatttgcgtctgaagctggccctgggggtgctggagaatccaagtgtcctctgatggtcaaagtcctggatgctgtccgaggcagccctgctgtcgatgtggccgtgaaagtgttcaaaaggactgcagacggaagctgggagccgtttgcctctgggaagaccgccgagtctggagagctgcacgggctcaccacagatgagaagttcacggaaggggtgtacagggtagaactggacaccaaatcatactggaaggctcttggcatttccccattccatgaatacgcagaggtggttttcacagccaatgactctggtcatcgccactacaccatcgcagccctgctcagcccgtactcctacagcaccactgctgtcgtcagtaacccccagaactgagggacccagcccacgaggaccaagatcttgccaaagcagtagctcccatttgtactgaaacagtgttcttgctctataaaccgtgttagcaactcgggaagatgccgtgaaacgttcttattaaaccacctttatttcattc

SEQ ID NO: 4 - DNA, 479 bp, Macaca fascicularis
  source 1..479: mol_type = genomic DNA
gcaggatggcttctcatcgtctgctcctcctctgcctcgctggactggtatttgtgtctgaggctggtcctacgggcgttgatgaatccaagtgtcctctgatggtcaaagttctagatgccgtccgaggcagtcctgctgtcaatgtggctgtgaacgtgttcaaaaaggctgctgatgagacctgggcgccatttgcctctgggaaaaccagtgagtctggagagctgcatgggctcacaactgaggaggaatttgtagaagggatatacaaagtggaaatagacaccaaatcttactggaagtcacttggcatctccccattccatgagcatgcagaggtggtattcacagccaacgattccggcccccgccactacaccatcgccgccctgctgagcccctactcctattccaccacggctgtcgtcaccaatcccaaggaatgagggacttctccagaggatctgaaggacgag

SEQ ID NO: 5 - DNA, 705 bp, Macaca mulatta
  source 1..705: mol_type = genomic DNA
gaatcagcaggtttggagtcagattggcagggataagcagcctagctcaggagaagtgggtataaaagccccaggctgggagcagccatcacagaagtccactcgttcttggcaggatggcttctcatcgtctgctcctcctctgcctcgctggactggtatttgtgtctgaggctggtcctacgggcgttgatgaatccaagtgtcctctgatggtcaaagttctagatgccgtccgaggcagtcctgctgtcaatgtggctgtgaacgtgttcaaaaaggctgctgatgagacctgggcgccatttgcctctgggaaaaccagtgagtctggagagctgcatgggctcacaactgaggaggaatttgtagaagggatatacaaagtggaaatagacaccaaatcttactggaagtcacttggcatctccccattccatgagcatgcagaggtggtattcacagccaacgattccggcccccgccactacaccatcgccgccctgctgagcccctactcctattccaccacggctgtcgtcaccaatcccaaggaatgagggacttctccagaggatctgaaggacgagggatgggatttcatgtaaccaagagtattccatttttactaaagcagtgttttcacctcataagctatgttaggagtccaggcagagacaataaaacattcctgtgaaaggcaaa

SEQ ID NO: 6 - DNA, 616 bp, Homo sapiens
  source 1..616: mol_type = genomic DNA
tgcctttcacaggaatgttttattgtctctgcctggacttctaacatagcatatgaggtgaaaacactgctttagtaaaaatggaatactcttggttacatgaaatcccatccctcgtccttcaggtccactggaggagaagtccctcattccttgggattggtgacgacagccgtggtggaataggagtaggggctcagcagggcggcaatggtgtagcggcgggggccggagtcgttggctgtgaataccacctctgcatgctcatggaatggggagatgccaagtgccttccagtaagatttggtgtctatttccactttgtatatcccttctacaaattcctcctcagttgtgagcccatgcagctctccagactcactggttttcccagaggcaaatggctcccaggtgtcatcagcagcctttctgaacacatgcacggccacattgatggcaggactgcctcggacagcatctagaactttgaccatcagaggacacttggattcaccggtgcccgtagggccagcctcagacacaaataccagtccagcaaggcagaggaggagcagacgatgagaagccatcctgccaagaatgagtggacttctgt

SEQ ID NO: 7 - DNA, 1050 bp, Mus musculus
  source 1..1050: mol_type = genomic DNA
cctagatttggctttatttagtcactaaaggttataaaaaaaaacccaaatatttcattttcagaatgttttttggcctacttttcagtattgtgattgaacccagggcttttgaacatgctctgggaaaacactactgtgcatctacagcccttcagattgtgtgcttttaatagctacagaccatgttagtgtatgttttgcttgtaaaacattgaacggttggtccactctgctttctgacctatcttcctcaagcaagttgccaggagcacccatgacctccccaagatggaaaggatgcctttaaaccatgagtcaaaaagtattttctttctttaaaaagtttgatcgcataccttctagaattctttaaaaaattttgggttttaggagcaggggagaaaaatgaggaaataaaaaagaaacacagtttgaatgaaatagcaggtggtttaataagaatgcttcacggcatcttcctgagctgctaacacggtttatagagcaagaacactgttttggtacaaatgggatgctactgctttggcaagatcctggtcctcctgggctgagtctctcaattctgggggttgctgacgacagccgtggtgctgtaggagtatgggctgagcagggctgcgatggtgtagtggcgatggccagagtcgttggctgtgaaaaccacatccgcgaattcatggaacggggaaatgccaagtgtcttccagtacgatttggtgtccagttctactctgtacactccttctacaaacttctcatctgtggtgagcccgtgcagctctccagactccgcggtcttcccagaggcaaagggctcccaggatccctcagaggtctttttgaacacttttacagccacgtctacagcagggctgcctcggacagcatccaggactttgaccatcagaggacatttggattctccagcacccgcggggccagcttcagacacaaataccagtccagcgaggcaaaggaggaagagtcgaagggaagccatcctgtcaggagcttgtggatctgtgt

SEQ ID NO: 8 - DNA, 595 bp, Rattus norvegicus
  source 1..595: mol_type = genomic DNA
gaatgaaataaaggtggtttaataagaacgtttcacggcatcttcccgagttgctaacacggtttatagagcaagaacactgtttcagtacaaatgggagctactgctttggcaagatcttggtcctcgtgggctgggtccctcagttctgggggttactgacgacagcagtggtgctgtaggagtacgggctgagcagggctgcgatggtgtagtggcgatgaccagagtcattggctgtgaaaaccacctctgcgtattcatggaatggggaaatgccaagagccttccagtatgatttggtgtccagttctaccctgtacaccccttccgtgaacttctcatctgtggtgagcccgtgcagctctccagactcggcggtcttcccagaggcaaacggctcccagcttccgtctgcagtccttttgaacactttcacggccacatcgacagcagggctgcctcggacagcatccaggactttgaccatcagaggacacttggattctccagcacccccagggccagcttcagacgcaaatatcagtccagcgaggcagaggaggaacaggcgaagggaagccatcctgtcagg

SEQ ID NO: 9 - DNA, 479 bp, Macaca fascicularis
  source 1..479: mol_type = genomic DNA
ctcgtccttcagatcctctggagaagtccctcattccttgggattggtgacgacagccgtggtggaataggagtaggggctcagcagggcggcgatggtgtagtggcgggggccggaatcgttggctgtgaataccacctctgcatgctcatggaatggggagatgccaagtgacttccagtaagatttggtgtctatttccactttgtatatcccttctacaaattcctcctcagttgtgagcccatgcagctctccagactcactggttttcccagaggcaaatggcgcccaggtctcatcagcagcctttttgaacacgttcacagccacattgacagcaggactgcctcggacggcatctagaactttgaccatcagaggacacttggattcatcaacgcccgtaggaccagcctcagacacaaataccagtccagcgaggcagaggaggagcagacgatgagaagccatcctgc

SEQ ID NO: 10 - DNA, 705 bp, Macaca mulatta
  source 1..705: mol_type = genomic DNA
tttgcctttcacaggaatgttttattgtctctgcctggactcctaacatagcttatgaggtgaaaacactgctttagtaaaaatggaatactcttggttacatgaaatcccatccctcgtccttcagatcctctggagaagtccctcattccttgggattggtgacgacagccgtggtggaataggagtaggggctcagcagggcggcgatggtgtagtggcgggggccggaatcgttggctgtgaataccacctctgcatgctcatggaatggggagatgccaagtgacttccagtaagatttggtgtctatttccactttgtatatcccttctacaaattcctcctcagttgtgagcccatgcagctctccagactcactggttttcccagaggcaaatggcgcccaggtctcatcagcagcctttttgaacacgttcacagccacattgacagcaggactgcctcggacggcatctagaactttgaccatcagaggacacttggattcatcaacgcccgtaggaccagcctcagacacaaataccagtccagcgaggcagaggaggagcagacgatgagaagccatcctgccaagaacgagtggacttctgtgatggctgctcccagcctggggcttttatacccacttctcctgagctaggctgcttatccctgccaatctgactccaaacctgctgattc

SEQ ID NO: 11 - RNA, 19 nt, synthetic construct
  modified_base 5: mod_base = OTHER; note = thymine
  misc_feature 1..19: note = Synthetic
  source 1..19: mol_type = other RNA
agagtattccatttttact

SEQ ID NO: 12 - RNA, 21 nt, synthetic construct
  misc_feature 1..21: note = Synthetic
  source 1..21: mol_type = other RNA
agtaaaaatggaatactcttg

SEQ ID NO: 13 - RNA, 21 nt, synthetic construct
  misc_feature 1..21: note = Synthetic
  source 1..21: mol_type = other RNA
caagagtattccatttttact

SEQ ID NO: 14 - protein, 16 aa, synthetic construct
  REGION 1..16: note = Synthetic
AAVALLPAVLLALLAP

SEQ ID NO: 15 - protein, 11 aa, synthetic construct
  REGION 1..11: note = Synthetic
AALLPVLLAAP

SEQ ID NO: 16 - protein, 13 aa, synthetic construct
  REGION 1..13: note = Synthetic
GRKKRRQRRRPPQ

SEQ ID NO: 17 - protein, 16 aa, synthetic construct
  REGION 1..16: note = Synthetic
RQIKIWFQNRRMKWKK

SEQ ID NO: 18 - RNA, 23 nt, synthetic construct
  misc_feature 1..23: note = Synthetic
  source 1..23: mol_type = other RNA
agtaaaaatggaatactcttggt

SEQ ID NO: 19 - RNA, 21 nt, synthetic construct
  misc_feature 1..21: note = Synthetic
  source 1..21: mol_type = other RNA
ccaagagtattccatttttat

SEQ ID NO: 20 - RNA, 23 nt, synthetic construct
  misc_feature 1..23: note = Synthetic
  source 1..23: mol_type = other RNA
ataaaaatggaatactcttggtt

SEQ ID NO: 21 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluorouridine-3'-phosphate
  modified_base 9..10: mod_base = OTHER; note = 2'-fluorouridine-3'-phosphate
  modified_base 11: mod_base = OTHER; note = 2'-fluorocytidine-3'-phosphate
  source 1..21: mol_type = other RNA
caagagtattccatttttact

SEQ ID NO: 22 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21..22: mod_base = OTHER; note = 2'-O-methylguanosine-3'- phosphorothioate
  source 1..23: mol_type = other RNA
agtaaaaatggaatactcttggt

SEQ ID NO: 23 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluorouridine-3'-phosphate
  modified_base 9..10: mod_base = OTHER; note = 2'-fluorouridine-3'-phosphate
  modified_base 11: mod_base = OTHER; note = 2'-fluorocytidine-3'-phosphate
  source 1..21: mol_type = other RNA
caagagtattccatttttact

SEQ ID NO: 24 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21..22: mod_base = OTHER; note = 2'-O-methylguanosine-3'- phosphorothioate
  source 1..23: mol_type = other RNA
agtaaaaatggaatactcttggt

SEQ ID NO: 25 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluorouridine-3'-phosphate
  modified_base 9..10: mod_base = OTHER; note = 2'-fluorouridine-3'-phosphate
  modified_base 11: mod_base = OTHER; note = 2'-fluorocytidine-3'-phosphate
  source 1..21: mol_type = other RNA
caagagtattccatttttact

SEQ ID NO: 26 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21..22: mod_base = OTHER; note = 2'-O-methylguanosine-3'- phosphorothioate
  source 1..23: mol_type = other RNA
agtaaaaatggaatactcttggt

SEQ ID NO: 27 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluorouridine-3'-phosphate
  modified_base 9..10: mod_base = OTHER; note = 2'-fluorouridine-3'-phosphate
  modified_base 11: mod_base = OTHER; note = 2'-fluorocytidine-3'-phosphate
  source 1..21: mol_type = other RNA
caagagtattccatttttact

SEQ ID NO: 28 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21..22: mod_base = OTHER; note = 2'-O-methylguanosine-3'- phosphorothioate
  source 1..23: mol_type = other RNA
agtaaaaatggaatactcttggt

SEQ ID NO: 29 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluorouridine-3'-phosphate
  modified_base 9..10: mod_base = OTHER; note = 2'-fluorouridine-3'-phosphate
  modified_base 11: mod_base = OTHER; note = 2'-fluorocytidine-3'-phosphate
  source 1..21: mol_type = other RNA
caagagtattccatttttact

SEQ ID NO: 30 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21..22: mod_base = OTHER; note = 2'-O-methylguanosine-3'- phosphorothioate
  source 1..23: mol_type = other RNA
agtaaaaatggaatactcttggt

SEQ ID NO: 31 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluorouridine-3'-phosphate
  modified_base 9..10: mod_base = OTHER; note = 2'-fluorouridine-3'-phosphate
  modified_base 11: mod_base = OTHER; note = 2'-fluorocytidine-3'-phosphate
  source 1..21: mol_type = other RNA
caagagtattccatttttact

SEQ ID NO: 32 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21..22: mod_base = OTHER; note = 2'-O-methylguanosine-3'- phosphorothioate
  source 1..23: mol_type = other RNA
agtaaaaatggaatactcttggt

SEQ ID NO: 33 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluorouridine-3'-phosphate
  modified_base 9..10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96 (N-[tris(GalNAc-alkyl)-amidodecanoyl)]-4-hydroxyprolinol
  source 1..21: mol_type = other RNA
caagagtattccatttttact

SEQ ID NO: 34 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21..22: mod_base = OTHER; note = 2'-O-methylguanosine-3'- phosphorothioate
  source 1..23: mol_type = other RNA
agtaaaaatggaatactcttggt

SEQ ID NO: 35 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10..11: mod_base = OTHER; note = 2'-fluorouridine-3'-phosphate
  source 1..21: mol_type = other RNA
ccaagagtattccatttttat

SEQ ID NO: 36 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  source 1..23: mol_type = other RNA
ataaaaatggaatactcttggtt

SEQ ID NO: 37 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10..11: mod_base = OTHER; note = 2'-fluorouridine-3'-phosphate
  source 1..21: mol_type = other RNA
ccaagagtattccatttttat

SEQ ID NO: 38 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  source 1..23: mol_type = other RNA
ataaaaatggaatactcttggtt

SEQ ID NO: 39 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10..11: mod_base = OTHER; note = 2'-fluorouridine-3'-phosphate
  source 1..21: mol_type = other RNA
ccaagagtattccatttttat

SEQ ID NO: 40 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  source 1..23: mol_type = other RNA
ataaaaatggaatactcttggtt

SEQ ID NO: 41 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10..11: mod_base = OTHER; note = 2'-fluorouridine-3'-phosphate
  source 1..21: mol_type = other RNA
ccaagagtattccatttttat

SEQ ID NO: 42 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  source 1..23: mol_type = other RNA
ataaaaatggaatactcttggtt

SEQ ID NO: 43 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10..11: mod_base = OTHER; note = 2'-fluorouridine-3'-phosphate
  source 1..21: mol_type = other RNA
ccaagagtattccatttttat

SEQ ID NO: 44 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  source 1..23: mol_type = other RNA
ataaaaatggaatactcttggtt

SEQ ID NO: 45 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10..11: mod_base = OTHER; note = 2'-fluorouridine-3'-phosphate
  source 1..21: mol_type = other RNA
ccaagagtattccatttttat

SEQ ID NO: 46 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  source 1..23: mol_type = other RNA
ataaaaatggaatactcttggtt

SEQ ID NO: 47 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10..11: mod_base = OTHER; note = 2'-fluorouridine-3'-phosphate
  source 1..21: mol_type = other RNA
ccaagagtattccatttttat

SEQ ID NO: 48 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  source 1..23: mol_type = other RNA
ataaaaatggaatactcttggtt

SEQ ID NO: 49 - RNA, 18 nt, synthetic construct
  misc_feature 1..18: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 5: mod_base = OTHER; note = 2'-deoxythimidine -3'-phosphate
  modified_base 7..8: mod_base = OTHER; note = 2'-fluorouridine-3'-phosphate
  modified_base 9: mod_base = OTHER; note = 2'-fluorocytidine-3'-phosphate
  source 1..18: mol_type = other RNA
agagattccatttttact

SEQ ID NO: 50 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 5: mod_base = OTHER; note = 2'-deoxyadenosine-3'-phosphate
  modified_base 7: mod_base = OTHER; note = 2'-deoxyadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19..20: mod_base = OTHER; note = 2'-O-methyluridine-3'-phosphorothioate
  source 1..21: mol_type = other RNA
agtaaaaatggaatactcttg

SEQ ID NO: 51 - RNA, 18 nt, synthetic construct
  misc_feature 1..18: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 5: mod_base = OTHER; note = 2'-deoxythimidine -3'-phosphate
  modified_base 7..8: mod_base = OTHER; note = 2'-fluorouridine-3'-phosphate
  modified_base 9: mod_base = OTHER; note = 2'-fluorocytidine-3'-phosphate
  source 1..18: mol_type = other RNA
agagattccatttttact

SEQ ID NO: 52 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 5: mod_base = OTHER; note = 2'-deoxyadenosine-3'-phosphate
  modified_base 7: mod_base = OTHER; note = 2'-deoxyadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19..20: mod_base = OTHER; note = 2'-O-methyluridine-3'-phosphorothioate
  source 1..21: mol_type = other RNA
agtaaaaatggaatactcttg

SEQ ID NO: 53 - RNA, 18 nt, synthetic construct
  misc_feature 1..18: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 5: mod_base = OTHER; note = 2'-deoxythimidine -3'-phosphate
  modified_base 7..8: mod_base = OTHER; note = 2'-fluorouridine-3'-phosphate
  modified_base 9: mod_base = OTHER; note = 2'-fluorocytidine-3'-phosphate
  source 1..18: mol_type = other RNA
agagattccatttttact

SEQ ID NO: 54 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 5: mod_base = OTHER; note = 2'-deoxyadenosine-3'-phosphate
  modified_base 7: mod_base = OTHER; note = 2'-deoxyadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19..20: mod_base = OTHER; note = 2'-O-methyluridine-3'-phosphorothioate
  source 1..21: mol_type = other RNA
agtaaaaatggaatactcttg

SEQ ID NO: 55 - RNA, 18 nt, synthetic construct
  misc_feature 1..18: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 5: mod_base = OTHER; note = 2'-deoxythimidine -3'-phosphate
  modified_base 7..8: mod_base = OTHER; note = 2'-fluorouridine-3'-phosphate
  modified_base 9: mod_base = OTHER; note = 2'-fluorocytidine-3'-phosphate
  source 1..18: mol_type = other RNA
agagattccatttttact

SEQ ID NO: 56 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 5: mod_base = OTHER; note = 2'-deoxyadenosine-3'-phosphate
  modified_base 7: mod_base = OTHER; note = 2'-deoxyadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19..20: mod_base = OTHER; note = 2'-O-methyluridine-3'-phosphorothioate
  source 1..21: mol_type = other RNA
agtaaaaatggaatactcttg

SEQ ID NO: 57 - RNA, 18 nt, synthetic construct
  misc_feature 1..18: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 5: mod_base = OTHER; note = 2'-deoxythimidine -3'-phosphate
  modified_base 7..8: mod_base = OTHER; note = 2'-fluorouridine-3'-phosphate
  modified_base 9: mod_base = OTHER; note = 2'-fluorocytidine-3'-phosphate
  source 1..18: mol_type = other RNA
agagattccatttttact

SEQ ID NO: 58 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 5: mod_base = OTHER; note = 2'-deoxyadenosine-3'-phosphate
  modified_base 7: mod_base = OTHER; note = 2'-deoxyadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19..20: mod_base = OTHER; note = 2'-O-methyluridine-3'-phosphorothioate
  source 1..21: mol_type = other RNA
agtaaaaatggaatactcttg

SEQ ID NO: 59 - RNA, 18 nt, synthetic construct
  misc_feature 1..18: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 5: mod_base = OTHER; note = 2'-deoxythimidine -3'-phosphate
  modified_base 7..8: mod_base = OTHER; note = 2'-fluorouridine-3'-phosphate
  modified_base 9: mod_base = OTHER; note = 2'-fluorocytidine-3'-phosphate
  source 1..18: mol_type = other RNA
agagattccatttttact

SEQ ID NO: 60 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 5: mod_base = OTHER; note = 2'-deoxyadenosine-3'-phosphate
  modified_base 7: mod_base = OTHER; note = 2'-deoxyadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19..20: mod_base = OTHER; note = 2'-O-methyluridine-3'-phosphorothioate
  source 1..21: mol_type = other RNA
agtaaaaatggaatactcttg

SEQ ID NO: 61 - RNA, 18 nt, synthetic construct
  misc_feature 1..18: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 5: mod_base = OTHER; note = 2'-deoxythimidine -3'-phosphate
  modified_base 7..8: mod_base = OTHER; note = 2'-fluorouridine-3'-phosphate
  modified_base 9: mod_base = OTHER; note = 2'-fluorocytidine-3'-phosphate
  source 1..18: mol_type = other RNA
agagattccatttttact

SEQ ID NO: 62 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 5: mod_base = OTHER; note = 2'-deoxyadenosine-3'-phosphate
  modified_base 7: mod_base = OTHER; note = 2'-deoxyadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19..20: mod_base = OTHER; note = 2'-O-methyluridine-3'-phosphorothioate
  source 1..21: mol_type = other RNA
agtaaaaatggaatactcttg

SEQ ID NO: 63 - RNA, 21 nt, synthetic construct
  misc_feature 1..21: note = Synthetic
  source 1..21: mol_type = other RNA
ctgaaggacgagggatgggat

SEQ ID NO: 64 - RNA, 23 nt, synthetic construct
  misc_feature 1..23: note = Synthetic
  source 1..23: mol_type = other RNA
atcccatccctcgtccttcaggt

SEQ ID NO: 65 - RNA, 21 nt, synthetic construct
  misc_feature 1..21: note = Synthetic
  source 1..21: mol_type = other RNA
tgaaggacgagggatgggatt

SEQ ID NO: 66 - RNA, 23 nt, synthetic construct
  misc_feature 1..23: note = Synthetic
  source 1..23: mol_type = other RNA
aatcccatccctcgtccttcagg

SEQ ID NO: 67 - RNA, 21 nt, synthetic construct
  misc_feature 1..21: note = Synthetic
  source 1..21: mol_type = other RNA
gaaggacgagggatgggattt

SEQ ID NO: 68 - RNA, 23 nt, synthetic construct
  misc_feature 1..23: note = Synthetic
  source 1..23: mol_type = other RNA
aaatcccatccctcgtccttcag

SEQ ID NO: 69 - RNA, 21 nt, synthetic construct
  misc_feature 1..21: note = Synthetic
  source 1..21: mol_type = other RNA
aaggacgagggatgggatttt

SEQ ID NO: 70 - RNA, 23 nt, synthetic construct
  misc_feature 1..23: note = Synthetic
  source 1..23: mol_type = other RNA
aaaatcccatccctcgtccttca

SEQ ID NO: 71 - RNA, 21 nt, synthetic construct
  misc_feature 1..21: note = Synthetic
  source 1..21: mol_type = other RNA
aggacgagggatgggatttca

SEQ ID NO: 72 - RNA, 23 nt, synthetic construct
  misc_feature 1..23: note = Synthetic
  source 1..23: mol_type = other RNA
tgaaatcccatccctcgtccttc

SEQ ID NO: 73 - RNA, 21 nt, synthetic construct
  misc_feature 1..21: note = Synthetic
  source 1..21: mol_type = other RNA
ggacgagggatgggatttcat

SEQ ID NO: 74 - RNA, 23 nt, synthetic construct
  misc_feature 1..23: note = Synthetic
  source 1..23: mol_type = other RNA
atgaaatcccatccctcgtcctt

SEQ ID NO: 75 - RNA, 21 nt, synthetic construct
  misc_feature 1..21: note = Synthetic
  source 1..21: mol_type = other RNA
gacgagggatgggatttcatt

SEQ ID NO: 76 - RNA, 23 nt, synthetic construct
  misc_feature 1..23: note = Synthetic
  source 1..23: mol_type = other RNA
aatgaaatcccatccctcgtcct

SEQ ID NO: 77 - RNA, 21 nt, synthetic construct
  misc_feature 1..21: note = Synthetic
  source 1..21: mol_type = other RNA
acgagggatgggatttcatgt

SEQ ID NO: 78 - RNA, 23 nt, synthetic construct
  misc_feature 1..23: note = Synthetic
  source 1..23: mol_type = other RNA
acatgaaatcccatccctcgtcc

SEQ ID NO: 79 - RNA, 21 nt, synthetic construct
  misc_feature 1..21: note = Synthetic
  source 1..21: mol_type = other RNA
cgagggatgggatttcatgta

SEQ ID NO: 80 - RNA, 23 nt, synthetic construct
  misc_feature 1..23: note = Synthetic
  source 1..23: mol_type = other RNA
tacatgaaatcccatccctcgtc

SEQ ID NO: 81 - RNA, 21 nt, synthetic construct
  misc_feature 1..21: note = Synthetic
  source 1..21: mol_type = other RNA
gagggatgggatttcatgtaa

SEQ ID NO: 82 - RNA, 23 nt, synthetic construct
  misc_feature 1..23: note = Synthetic
  source 1..23: mol_type = other RNA
ttacatgaaatcccatccctcgt

SEQ ID NO: 83 - RNA, 21 nt, synthetic construct
  misc_feature 1..21: note = Synthetic
  source 1..21: mol_type = other RNA
agggatgggatttcatgtaat

SEQ ID NO: 84 - RNA, 23 nt, synthetic construct
  misc_feature 1..23: note = Synthetic
  source 1..23: mol_type = other RNA
attacatgaaatcccatccctcg

SEQ ID NO: 85 - RNA, 21 nt, synthetic construct
  misc_feature 1..21: note = Synthetic
  source 1..21: mol_type = other RNA
gggatgggatttcatgtaact

SEQ ID NO: 86 - RNA, 23 nt, synthetic construct
  misc_feature 1..23: note = Synthetic
  source 1..23: mol_type = other RNA
agttacatgaaatcccatccctc

SEQ ID NO: 87 - RNA, 21 nt, synthetic construct
  misc_feature 1..21: note = Synthetic
  source 1..21: mol_type = other RNA
ggatgggatttcatgtaacca

SEQ ID NO: 88 - RNA, 23 nt, synthetic construct
  misc_feature 1..23: note = Synthetic
  source 1..23: mol_type = other RNA
tggttacatgaaatcccatccct

SEQ ID NO: 89 - RNA, 21 nt, synthetic construct
  misc_feature 1..21: note = Synthetic
  source 1..21: mol_type = other RNA
gatgggatttcatgtaaccaa

SEQ ID NO: 90 - RNA, 23 nt, synthetic construct
  misc_feature 1..23: note = Synthetic
  source 1..23: mol_type = other RNA
ttggttacatgaaatcccatccc

SEQ ID NO: 91 - RNA, 21 nt, synthetic construct
  misc_feature 1..21: note = Synthetic
  source 1..21: mol_type = other RNA
atgggatttcatgtaaccaat

SEQ ID NO: 92 - RNA, 23 nt, synthetic construct
  misc_feature 1..23: note = Synthetic
  source 1..23: mol_type = other RNA
attggttacatgaaatcccatcc

SEQ ID NO: 93 - RNA, 21 nt, synthetic construct
  misc_feature 1..21: note = Synthetic
  source 1..21: mol_type = other RNA
gggatttcatgtaaccaagat

SEQ ID NO: 94 - RNA, 23 nt, synthetic construct
  misc_feature 1..23: note = Synthetic
  source 1..23: mol_type = other RNA
atcttggttacatgaaatcccat

SEQ ID NO: 95 - RNA, 21 nt, synthetic construct
  misc_feature 1..21: note = Synthetic
  source 1..21: mol_type = other RNA
ggatttcatgtaaccaagagt

SEQ ID NO: 96 - RNA, 23 nt, synthetic construct
  misc_feature 1..23: note = Synthetic
  source 1..23: mol_type = other RNA
actcttggttacatgaaatccca

SEQ ID NO: 97 - RNA, 21 nt, synthetic construct
  misc_feature 1..21: note = Synthetic
  source 1..21: mol_type = other RNA
gatttcatgtaaccaagagta

SEQ ID NO: 98 - RNA, 23 nt, synthetic construct
  misc_feature 1..23: note = Synthetic
  source 1..23: mol_type = other RNA
tactcttggttacatgaaatccc

SEQ ID NO: 99 - RNA, 21 nt, synthetic construct
  misc_feature 1..21: note = Synthetic
  source 1..21: mol_type = other RNA
atttcatgtaaccaagagtat

SEQ ID NO: 100 - RNA, 23 nt, synthetic construct
  misc_feature 1..23: note = Synthetic
  source 1..23: mol_type = other RNA
atactcttggttacatgaaatcc

SEQ ID NO: 101 - RNA, 21 nt, synthetic construct
  misc_feature 1..21: note = Synthetic
  source 1..21: mol_type = other RNA
ttcatgtaaccaagagtattt

SEQ ID NO: 102 - RNA, 23 nt, synthetic construct
  misc_feature 1..23: note = Synthetic
  source 1..23: mol_type = other RNA
aaatactcttggttacatgaaat

SEQ ID NO: 103 - RNA, 21 nt, synthetic construct
  misc_feature 1..21: note = Synthetic
  source 1..21: mol_type = other RNA
catgtaaccaagagtattcca

SEQ ID NO: 104 - RNA, 23 nt, synthetic construct
  misc_feature 1..23: note = Synthetic
  source 1..23: mol_type = other RNA
tggaatactcttggttacatgaa

SEQ ID NO: 105 - RNA, 21 nt, synthetic construct
  misc_feature 1..21: note = Synthetic
  source 1..21: mol_type = other RNA
atgtaaccaagagtattccat

SEQ ID NO: 106 - RNA, 23 nt, synthetic construct
  misc_feature 1..23: note = Synthetic
  source 1..23: mol_type = other RNA
atggaatactcttggttacatga

SEQ ID NO: 107 - RNA, 21 nt, synthetic construct
  misc_feature 1..21: note = Synthetic
  source 1..21: mol_type = other RNA
gtaaccaagagtattccattt

SEQ ID NO: 108 - RNA, 23 nt, synthetic construct
  misc_feature 1..23: note = Synthetic
  source 1..23: mol_type = other RNA
aaatggaatactcttggttacat

SEQ ID NO: 109 - RNA, 21 nt, synthetic construct
  misc_feature 1..21: note = Synthetic
  source 1..21: mol_type = other RNA
taaccaagagtattccatttt

SEQ ID NO: 110 - RNA, 23 nt, synthetic construct
  misc_feature 1..23: note = Synthetic
  source 1..23: mol_type = other RNA
aaaatggaatactcttggttaca

SEQ ID NO: 111 - RNA, 21 nt, synthetic construct
  misc_feature 1..21: note = Synthetic
  source 1..21: mol_type = other RNA
accaagagtattccattttta

SEQ ID NO: 112 - RNA, 23 nt, synthetic construct
  misc_feature 1..23: note = Synthetic
  source 1..23: mol_type = other RNA
taaaaatggaatactcttggtta

SEQ ID NO: 113 - RNA, 21 nt, synthetic construct
  misc_feature 1..21: note = Synthetic
  source 1..21: mol_type = other RNA
ccaagagtattccatttttat

SEQ ID NO: 114 - RNA, 23 nt, synthetic construct
  misc_feature 1..23: note = Synthetic
  source 1..23: mol_type = other RNA
ataaaaatggaatactcttggtt

SEQ ID NO: 115 - RNA, 21 nt, synthetic construct
  misc_feature 1..21: note = Synthetic
  source 1..21: mol_type = other RNA
caagagtattccatttttact

SEQ ID NO: 116 - RNA, 23 nt, synthetic construct
  misc_feature 1..23: note = Synthetic
  source 1..23: mol_type = other RNA
agtaaaaatggaatactcttggt

SEQ ID NO: 117 - RNA, 21 nt, synthetic construct
  misc_feature 1..21: note = Synthetic
  source 1..21: mol_type = other RNA
aagagtattccatttttacta

SEQ ID NO: 118 - RNA, 23 nt, synthetic construct
  misc_feature 1..23: note = Synthetic
  source 1..23: mol_type = other RNA
tagtaaaaatggaatactcttgg

SEQ ID NO: 119 - RNA, 21 nt, synthetic construct
  misc_feature 1..21: note = Synthetic
  source 1..21: mol_type = other RNA
agagtattccatttttactaa

SEQ ID NO: 120 - RNA, 23 nt, synthetic construct
  misc_feature 1..23: note = Synthetic
  source 1..23: mol_type = other RNA
ttagtaaaaatggaatactcttg

SEQ ID NO: 121 - RNA, 21 nt, synthetic construct
  misc_feature 1..21: note = Synthetic
  source 1..21: mol_type = other RNA
gagtattccatttttactaaa

SEQ ID NO: 122 - RNA, 23 nt, synthetic construct
  misc_feature 1..23: note = Synthetic
  source 1..23: mol_type = other RNA
tttagtaaaaatggaatactctt

SEQ ID NO: 123 - RNA, 21 nt, synthetic construct
  misc_feature 1..21: note = Synthetic
  source 1..21: mol_type = other RNA
agtattccatttttactaaat

SEQ ID NO: 124 - RNA, 23 nt, synthetic construct
  misc_feature 1..23: note = Synthetic
  source 1..23: mol_type = other RNA
atttagtaaaaatggaatactct

SEQ ID NO: 125 - RNA, 21 nt, synthetic construct
  misc_feature 1..21: note = Synthetic
  source 1..21: mol_type = other RNA
gtattccatttttactaaagt

SEQ ID NO: 126 - RNA, 23 nt, synthetic construct
  misc_feature 1..23: note = Synthetic
  source 1..23: mol_type = other RNA
actttagtaaaaatggaatactc

SEQ ID NO: 127 - RNA, 21 nt, synthetic construct
  misc_feature 1..21: note = Synthetic
  source 1..21: mol_type = other RNA
tattccatttttactaaagca

SEQ ID NO: 128 - RNA, 23 nt, synthetic construct
  misc_feature 1..23: note = Synthetic
  source 1..23: mol_type = other RNA
tgctttagtaaaaatggaatact

SEQ ID NO: 129 - RNA, 21 nt, synthetic construct
  misc_feature 1..21: note = Synthetic
  source 1..21: mol_type = other RNA
attccatttttactaaagcat

SEQ ID NO: 130 - RNA, 23 nt, synthetic construct
  misc_feature 1..23: note = Synthetic
  source 1..23: mol_type = other RNA
atgctttagtaaaaatggaatac

SEQ ID NO: 131 - RNA, 21 nt, synthetic construct
  misc_feature 1..21: note = Synthetic
  source 1..21: mol_type = other RNA
ttccatttttactaaagcagt

SEQ ID NO: 132 - RNA, 23 nt, synthetic construct
  misc_feature 1..23: note = Synthetic
  source 1..23: mol_type = other RNA
actgctttagtaaaaatggaata

SEQ ID NO: 133 - RNA, 21 nt, synthetic construct
  misc_feature 1..21: note = Synthetic
  source 1..21: mol_type = other RNA
ccatttttactaaagcagtgt

SEQ ID NO: 134 - RNA, 23 nt, synthetic construct
  misc_feature 1..23: note = Synthetic
  source 1..23: mol_type = other RNA
acactgctttagtaaaaatggaa

SEQ ID NO: 135 - RNA, 21 nt, synthetic construct
  misc_feature 1..21: note = Synthetic
  source 1..21: mol_type = other RNA
catttttactaaagcagtgtt

SEQ ID NO: 136 - RNA, 23 nt, synthetic construct
  misc_feature 1..23: note = Synthetic
  source 1..23: mol_type = other RNA
aacactgctttagtaaaaatgga

SEQ ID NO: 137 - RNA, 21 nt, synthetic construct
  misc_feature 1..21: note = Synthetic
  source 1..21: mol_type = other RNA
atttttactaaagcagtgttt

SEQ ID NO: 138 - RNA, 23 nt, synthetic construct
  misc_feature 1..23: note = Synthetic
  source 1..23: mol_type = other RNA
aaacactgctttagtaaaaatgg

SEQ ID NO: 139 - RNA, 21 nt, synthetic construct
  misc_feature 1..21: note = Synthetic
  source 1..21: mol_type = other RNA
ttttactaaagcagtgttttt

SEQ ID NO: 140 - RNA, 23 nt, synthetic construct
  misc_feature 1..23: note = Synthetic
  source 1..23: mol_type = other RNA
aaaaacactgctttagtaaaaat

SEQ ID NO: 141 - RNA, 21 nt, synthetic construct
  misc_feature 1..21: note = Synthetic
  source 1..21: mol_type = other RNA
tttactaaagcagtgttttca

SEQ ID NO: 142 - RNA, 23 nt, synthetic construct
  misc_feature 1..23: note = Synthetic
  source 1..23: mol_type = other RNA
tgaaaacactgctttagtaaaaa

SEQ ID NO: 143 - RNA, 21 nt, synthetic construct
  misc_feature 1..21: note = Synthetic
  source 1..21: mol_type = other RNA
ttactaaagcagtgttttcat

SEQ ID NO: 144 - RNA, 23 nt, synthetic construct
  misc_feature 1..23: note = Synthetic
  source 1..23: mol_type = other RNA
atgaaaacactgctttagtaaaa

SEQ ID NO: 145 - RNA, 21 nt, synthetic construct
  misc_feature 1..21: note = Synthetic
  source 1..21: mol_type = other RNA
tactaaagcagtgttttcact

SEQ ID NO: 146 - RNA, 23 nt, synthetic construct
  misc_feature 1..23: note = Synthetic
  source 1..23: mol_type = other RNA
agtgaaaacactgctttagtaaa

SEQ ID NO: 147 - RNA, 21 nt, synthetic construct
  misc_feature 1..21: note = Synthetic
  source 1..21: mol_type = other RNA
actaaagcagtgttttcacct

SEQ ID NO: 148 - RNA, 23 nt, synthetic construct
  misc_feature 1..23: note = Synthetic
  source 1..23: mol_type = other RNA
aggtgaaaacactgctttagtaa

SEQ ID NO: 149 - RNA, 21 nt, synthetic construct
  misc_feature 1..21: note = Synthetic
  source 1..21: mol_type = other RNA
ctaaagcagtgttttcacctt

SEQ ID NO: 150 - RNA, 23 nt, synthetic construct
  misc_feature 1..23: note = Synthetic
  source 1..23: mol_type = other RNA
aaggtgaaaacactgctttagta

SEQ ID NO: 151 - RNA, 21 nt, synthetic construct
  misc_feature 1..21: note = Synthetic
  source 1..21: mol_type = other RNA
taaagcagtgttttcacctca

SEQ ID NO: 152 - RNA, 23 nt, synthetic construct
  misc_feature 1..23: note = Synthetic
  source 1..23: mol_type = other RNA
tgaggtgaaaacactgctttagt

SEQ ID NO: 153 - RNA, 21 nt, synthetic construct
  misc_feature 1..21: note = Synthetic
  source 1..21: mol_type = other RNA
aaagcagtgttttcacctcat

SEQ ID NO: 154 - RNA, 23 nt, synthetic construct
  misc_feature 1..23: note = Synthetic
  source 1..23: mol_type = other RNA
atgaggtgaaaacactgctttag

SEQ ID NO: 155 - RNA, 21 nt, synthetic construct
  misc_feature 1..21: note = Synthetic
  source 1..21: mol_type = other RNA
aagcagtgttttcacctcata

SEQ ID NO: 156 - RNA, 23 nt, synthetic construct
  misc_feature 1..23: note = Synthetic
  source 1..23: mol_type = other RNA
tatgaggtgaaaacactgcttta

SEQ ID NO: 157 - RNA, 21 nt, synthetic construct
  misc_feature 1..21: note = Synthetic
  source 1..21: mol_type = other RNA
agcagtgttttcacctcatat

SEQ ID NO: 158 - RNA, 23 nt, synthetic construct
  misc_feature 1..23: note = Synthetic
  source 1..23: mol_type = other RNA
atatgaggtgaaaacactgcttt

SEQ ID NO: 159 - RNA, 21 nt, synthetic construct
  misc_feature 1..21: note = Synthetic
  source 1..21: mol_type = other RNA
agaagtccaggcagagacaat

SEQ ID NO: 160 - RNA, 23 nt, synthetic construct
  misc_feature 1..23: note = Synthetic
  source 1..23: mol_type = other RNA
attgtctctgcctggacttctaa

SEQ ID NO: 161 - RNA, 21 nt, synthetic construct
  misc_feature 1..21: note = Synthetic
  source 1..21: mol_type = other RNA
gaagtccaggcagagacaata

SEQ ID NO: 162 - RNA, 23 nt, synthetic construct
  misc_feature 1..23: note = Synthetic
  source 1..23: mol_type = other RNA
tattgtctctgcctggacttcta

SEQ ID NO: 163 - RNA, 21 nt, synthetic construct
  misc_feature 1..21: note = Synthetic
  source 1..21: mol_type = other RNA
agtccaggcagagacaataaa

SEQ ID NO: 164 - RNA, 23 nt, synthetic construct
  misc_feature 1..23: note = Synthetic
  source 1..23: mol_type = other RNA
tttattgtctctgcctggacttc

SEQ ID NO: 165 - RNA, 21 nt, synthetic construct
  misc_feature 1..21: note = Synthetic
  source 1..21: mol_type = other RNA
gtccaggcagagacaataaaa

SEQ ID NO: 166 - RNA, 23 nt, synthetic construct
  misc_feature 1..23: note = Synthetic
  source 1..23: mol_type = other RNA
ttttattgtctctgcctggactt

SEQ ID NO: 167 - RNA, 21 nt, synthetic construct
  misc_feature 1..21: note = Synthetic
  source 1..21: mol_type = other RNA
tccaggcagagacaataaaat

SEQ ID NO: 168 - RNA, 23 nt, synthetic construct
  misc_feature 1..23: note = Synthetic
  source 1..23: mol_type = other RNA
attttattgtctctgcctggact

SEQ ID NO: 169 - RNA, 21 nt, synthetic construct
  misc_feature 1..21: note = Synthetic
  source 1..21: mol_type = other RNA
ccaggcagagacaataaaaca

SEQ ID NO: 170 - RNA, 23 nt, synthetic construct
  misc_feature 1..23: note = Synthetic
  source 1..23: mol_type = other RNA
tgttttattgtctctgcctggac

SEQ ID NO: 171 - RNA, 21 nt, synthetic construct
  misc_feature 1..21: note = Synthetic
  source 1..21: mol_type = other RNA
caggcagagacaataaaacat

SEQ ID NO: 172 - RNA, 23 nt, synthetic construct
  misc_feature 1..23: note = Synthetic
  source 1..23: mol_type = other RNA
atgttttattgtctctgcctgga

SEQ ID NO: 173 - RNA, 21 nt, synthetic construct
  misc_feature 1..21: note = Synthetic
  source 1..21: mol_type = other RNA
aggcagagacaataaaacatt

SEQ ID NO: 174 - RNA, 23 nt, synthetic construct
  misc_feature 1..23: note = Synthetic
  source 1..23: mol_type = other RNA
aatgttttattgtctctgcctgg

SEQ ID NO: 175 - RNA, 21 nt, synthetic construct
  misc_feature 1..21: note = Synthetic
  source 1..21: mol_type = other RNA
ggcagagacaataaaacattt

SEQ ID NO: 176 - RNA, 23 nt, synthetic construct
  misc_feature 1..23: note = Synthetic
  source 1..23: mol_type = other RNA
aaatgttttattgtctctgcctg

SEQ ID NO: 177 - RNA, 21 nt, synthetic construct
  misc_feature 1..21: note = Synthetic
  source 1..21: mol_type = other RNA
gcagagacaataaaacattct

SEQ ID NO: 178 - RNA, 23 nt, synthetic construct
  misc_feature 1..23: note = Synthetic
  source 1..23: mol_type = other RNA
agaatgttttattgtctctgcct

SEQ ID NO: 179 - RNA, 21 nt, synthetic construct
  misc_feature 1..21: note = Synthetic
  source 1..21: mol_type = other RNA
agagacaataaaacattcctt

SEQ ID NO: 180 - RNA, 23 nt, synthetic construct
  misc_feature 1..23: note = Synthetic
  source 1..23: mol_type = other RNA
aaggaatgttttattgtctctgc

SEQ ID NO: 181 - RNA, 21 nt, synthetic construct
  misc_feature 1..21: note = Synthetic
  source 1..21: mol_type = other RNA
gagacaataaaacattcctgt

SEQ ID NO: 182 - RNA, 23 nt, synthetic construct
  misc_feature 1..23: note = Synthetic
  source 1..23: mol_type = other RNA
acaggaatgttttattgtctctg

SEQ ID NO: 183 - RNA, 21 nt, synthetic construct
  misc_feature 1..21: note = Synthetic
  source 1..21: mol_type = other RNA
agacaataaaacattcctgtt

SEQ ID NO: 184 - RNA, 23 nt, synthetic construct
  misc_feature 1..23: note = Synthetic
  source 1..23: mol_type = other RNA
aacaggaatgttttattgtctct

SEQ ID NO: 185 - RNA, 21 nt, synthetic construct
  misc_feature 1..21: note = Synthetic
  source 1..21: mol_type = other RNA
gacaataaaacattcctgtga

SEQ ID NO: 186 - RNA, 23 nt, synthetic construct
  misc_feature 1..23: note = Synthetic
  source 1..23: mol_type = other RNA
tcacaggaatgttttattgtctc

SEQ ID NO: 187 - RNA, 21 nt, synthetic construct
  misc_feature 1..21: note = Synthetic
  source 1..21: mol_type = other RNA
acaataaaacattcctgtgaa

SEQ ID NO: 188 - RNA, 23 nt, synthetic construct
  misc_feature 1..23: note = Synthetic
  source 1..23: mol_type = other RNA
ttcacaggaatgttttattgtct

SEQ ID NO: 189 - RNA, 21 nt, synthetic construct
  misc_feature 1..21: note = Synthetic
  source 1..21: mol_type = other RNA
aataaaacattcctgtgaaat

SEQ ID NO: 190 - RNA, 23 nt, synthetic construct
  misc_feature 1..23: note = Synthetic
  source 1..23: mol_type = other RNA
atttcacaggaatgttttattgt

SEQ ID NO: 191 - RNA, 21 nt, synthetic construct
  misc_feature 1..21: note = Synthetic
  source 1..21: mol_type = other RNA
ataaaacattcctgtgaaagt

SEQ ID NO: 192 - RNA, 23 nt, synthetic construct
  misc_feature 1..23: note = Synthetic
  source 1..23: mol_type = other RNA
actttcacaggaatgttttattg

SEQ ID NO: 193 - RNA, 21 nt, synthetic construct
  misc_feature 1..21: note = Synthetic
  source 1..21: mol_type = other RNA
taaaacattcctgtgaaaggt

SEQ ID NO: 194 - RNA, 23 nt, synthetic construct
  misc_feature 1..23: note = Synthetic
  source 1..23: mol_type = other RNA
acctttcacaggaatgttttatt

SEQ ID NO: 195 - RNA, 21 nt, synthetic construct
  misc_feature 1..21: note = Synthetic
  source 1..21: mol_type = other RNA
aaaacattcctgtgaaaggca

SEQ ID NO: 196 - RNA, 23 nt, synthetic construct
  misc_feature 1..23: note = Synthetic
  source 1..23: mol_type = other RNA
tgcctttcacaggaatgttttat

SEQ ID NO: 197 - RNA, 21 nt, synthetic construct
  misc_feature 1..21: note = Synthetic
  source 1..21: mol_type = other RNA
aaacattcctgtgaaaggcat

SEQ ID NO: 198 - RNA, 23 nt, synthetic construct
  misc_feature 1..23: note = Synthetic
  source 1..23: mol_type = other RNA
atgcctttcacaggaatgtttta

SEQ ID NO: 199 - RNA, 21 nt, synthetic construct
  misc_feature 1..21: note = Synthetic
  source 1..21: mol_type = other RNA
aacattcctgtgaaaggcact

SEQ ID NO: 200 - RNA, 23 nt, synthetic construct
  misc_feature 1..23: note = Synthetic
  source 1..23: mol_type = other RNA
agtgcctttcacaggaatgtttt

SEQ ID NO: 201 - RNA, 21 nt, synthetic construct
  misc_feature 1..21: note = Synthetic
  source 1..21: mol_type = other RNA
acattcctgtgaaaggcactt

SEQ ID NO: 202 - RNA, 23 nt, synthetic construct
  misc_feature 1..23: note = Synthetic
  source 1..23: mol_type = other RNA
aagtgcctttcacaggaatgttt

SEQ ID NO: 203 - RNA, 21 nt, synthetic construct
  misc_feature 1..21: note = Synthetic
  source 1..21: mol_type = other RNA
cattcctgtgaaaggcacttt

SEQ ID NO: 204 - RNA, 23 nt, synthetic construct
  misc_feature 1..23: note = Synthetic
  source 1..23: mol_type = other RNA
aaagtgcctttcacaggaatgtt

SEQ ID NO: 205 - RNA, 21 nt, synthetic construct
  misc_feature 1..21: note = Synthetic
  source 1..21: mol_type = other RNA
attcctgtgaaaggcactttt

SEQ ID NO: 206 - RNA, 23 nt, synthetic construct
  misc_feature 1..23: note = Synthetic
  source 1..23: mol_type = other RNA
aaaagtgcctttcacaggaatgt

SEQ ID NO: 207 - RNA, 21 nt, synthetic construct
  misc_feature 1..21: note = Synthetic
  source 1..21: mol_type = other RNA
ttcctgtgaaaggcacttttt

SEQ ID NO: 208 - RNA, 23 nt, synthetic construct
  misc_feature 1..23: note = Synthetic
  source 1..23: mol_type = other RNA
aaaaagtgcctttcacaggaatg

SEQ ID NO: 209 - RNA, 21 nt, synthetic construct
  misc_feature 1..21: note = Synthetic
  source 1..21: mol_type = other RNA
tcctgtgaaaggcacttttca

SEQ ID NO: 210 - RNA, 23 nt, synthetic construct
  misc_feature 1..23: note = Synthetic
  source 1..23: mol_type = other RNA
tgaaaagtgcctttcacaggaat

SEQ ID NO: 211 - RNA, 21 nt, synthetic construct
  misc_feature 1..21: note = Synthetic
  source 1..21: mol_type = other RNA
cctgtgaaaggcacttttcat

SEQ ID NO: 212 - RNA, 23 nt, synthetic construct
  misc_feature 1..23: note = Synthetic
  source 1..23: mol_type = other RNA
atgaaaagtgcctttcacaggaa

SEQ ID NO: 213 - RNA, 21 nt, synthetic construct
  misc_feature 1..21: note = Synthetic
  source 1..21: mol_type = other RNA
ctgtgaaaggcacttttcatt

SEQ ID NO: 214 - RNA, 23 nt, synthetic construct
  misc_feature 1..23: note = Synthetic
  source 1..23: mol_type = other RNA
aatgaaaagtgcctttcacagga

SEQ ID NO: 215 - RNA, 21 nt, synthetic construct
  misc_feature 1..21: note = Synthetic
  source 1..21: mol_type = other RNA
tgtgaaaggcacttttcattt

SEQ ID NO: 216 - RNA, 23 nt, synthetic construct
  misc_feature 1..23: note = Synthetic
  source 1..23: mol_type = other RNA
aaatgaaaagtgcctttcacagg

SEQ ID NO: 217 - RNA, 21 nt, synthetic construct
  misc_feature 1..21: note = Synthetic
  source 1..21: mol_type = other RNA
tgaaaggcacttttcattcca

SEQ ID NO: 218 - RNA, 23 nt, synthetic construct
  misc_feature 1..23: note = Synthetic
  source 1..23: mol_type = other RNA
tggaatgaaaagtgcctttcaca

SEQ ID NO: 219 - RNA, 21 nt, synthetic construct
  misc_feature 1..21: note = Synthetic
  source 1..21: mol_type = other RNA
gaaaggcacttttcattccat

SEQ ID NO: 220 - RNA, 23 nt, synthetic construct
  misc_feature 1..23: note = Synthetic
  source 1..23: mol_type = other RNA
atggaatgaaaagtgcctttcac

SEQ ID NO: 221 - RNA, 21 nt, synthetic construct
  misc_feature 1..21: note = Synthetic
  source 1..21: mol_type = other RNA
ctgaaggacgagggatgggat

SEQ ID NO: 222 - RNA, 23 nt, synthetic construct
  modified_base 7: mod_base = OTHER; note = thymine
  misc_feature 1..23: note = Synthetic
  source 1..23: mol_type = other RNA
atcccatccctcgtccttcaggt

SEQ ID NO: 223 - RNA, 21 nt, synthetic construct
  misc_feature 1..21: note = Synthetic
  source 1..21: mol_type = other RNA
tgaaggacgagggatgggatt

SEQ ID NO: 224 - RNA, 23 nt, synthetic construct
  misc_feature 1..23: note = Synthetic
  source 1..23: mol_type = other RNA
aatcccatccctcgtccttcagg

SEQ ID NO: 225 - RNA, 21 nt, synthetic construct
  misc_feature 1..21: note = Synthetic
  source 1..21: mol_type = other RNA
gaaggacgagggatgggattt

SEQ ID NO: 226 - RNA, 23 nt, synthetic construct
  misc_feature 1..23: note = Synthetic
  source 1..23: mol_type = other RNA
aaatcccatccctcgtccttcag

SEQ ID NO: 227 - RNA, 21 nt, synthetic construct
  misc_feature 1..21: note = Synthetic
  source 1..21: mol_type = other RNA
aaggacgagggatgggatttt

SEQ ID NO: 228 - RNA, 23 nt, synthetic construct
  misc_feature 1..23: note = Synthetic
  source 1..23: mol_type = other RNA
aaaatcccatccctcgtccttca

SEQ ID NO: 229 - RNA, 21 nt, synthetic construct
  misc_feature 1..21: note = Synthetic
  source 1..21: mol_type = other RNA
aggacgagggatgggatttca

SEQ ID NO: 230 - RNA, 23 nt, synthetic construct
  misc_feature 1..23: note = Synthetic
  source 1..23: mol_type = other RNA
tgaaatcccatccctcgtccttc

SEQ ID NO: 231 - RNA, 21 nt, synthetic construct
  misc_feature 1..21: note = Synthetic
  source 1..21: mol_type = other RNA
ggacgagggatgggatttcat

SEQ ID NO: 232 - RNA, 23 nt, synthetic construct
  modified_base 7: mod_base = OTHER; note = thymine
  misc_feature 1..23: note = Synthetic
  source 1..23: mol_type = other RNA
atgaaatcccatccctcgtcctt

SEQ ID NO: 233 - RNA, 21 nt, synthetic construct
  misc_feature 1..21: note = Synthetic
  source 1..21: mol_type = other RNA
gacgagggatgggatttcatt

SEQ ID NO: 234 - RNA, 23 nt, synthetic construct
  misc_feature 1..23: note = Synthetic
  source 1..23: mol_type = other RNA
aatgaaatcccatccctcgtcct

SEQ ID NO: 235 - RNA, 21 nt, synthetic construct
  misc_feature 1..21: note = Synthetic
  source 1..21: mol_type = other RNA
acgagggatgggatttcatgt

SEQ ID NO: 236 - RNA, 23 nt, synthetic construct
  misc_feature 1..23: note = Synthetic
  source 1..23: mol_type = other RNA
acatgaaatcccatccctcgtcc

SEQ ID NO: 237 - RNA, 21 nt, synthetic construct
  misc_feature 1..21: note = Synthetic
  source 1..21: mol_type = other RNA
cgagggatgggatttcatgta

SEQ ID NO: 238 - RNA, 23 nt, synthetic construct
  misc_feature 1..23: note = Synthetic
  source 1..23: mol_type = other RNA
tacatgaaatcccatccctcgtc

SEQ ID NO: 239 - RNA, 21 nt, synthetic construct
  misc_feature 1..21: note = Synthetic
  source 1..21: mol_type = other RNA
gagggatgggatttcatgtaa

SEQ ID NO: 240 - RNA, 23 nt, synthetic construct
  modified_base 6: mod_base = OTHER; note = thymine
  misc_feature 1..23: note = Synthetic
  source 1..23: mol_type = other RNA
ttacatgaaatcccatccctcgt

SEQ ID NO: 241 - RNA, 21 nt, synthetic construct
  misc_feature 1..21: note = Synthetic
  source 1..21: mol_type = other RNA
agggatgggatttcatgtaat

SEQ ID NO: 242 - RNA, 23 nt, synthetic construct
  modified_base 7: mod_base = OTHER; note = thymine
  misc_feature 1..23: note = Synthetic
  source 1..23: mol_type = other RNA
attacatgaaatcccatccctcg

SEQ ID NO: 243 - RNA, 21 nt, synthetic construct
  misc_feature 1..21: note = Synthetic
  source 1..21: mol_type = other RNA
gggatgggatttcatgtaact

SEQ ID NO: 244 - RNA, 23 nt, synthetic construct
  misc_feature 1..23: note = Synthetic
  source 1..23: mol_type = other RNA
agttacatgaaatcccatccctc

SEQ ID NO: 245 - RNA, 21 nt, synthetic construct
  misc_feature 1..21: note = Synthetic
  source 1..21: mol_type = other RNA
ggatgggatttcatgtaacca

SEQ ID NO: 246 - RNA, 23 nt, synthetic construct
  misc_feature 1..23: note = Synthetic
  source 1..23: mol_type = other RNA
tggttacatgaaatcccatccct

SEQ ID NO: 247 - RNA, 21 nt, synthetic construct
  misc_feature 1..21: note = Synthetic
  source 1..21: mol_type = other RNA
gatgggatttcatgtaaccaa

SEQ ID NO: 248 - RNA, 23 nt, synthetic construct
  misc_feature 1..23: note = Synthetic
  source 1..23: mol_type = other RNA
ttggttacatgaaatcccatccc

SEQ ID NO: 249 - RNA, 21 nt, synthetic construct
  misc_feature 1..21: note = Synthetic
  source 1..21: mol_type = other RNA
atgggatttcatgtaaccaat

SEQ ID NO: 250 - RNA, 23 nt, synthetic construct
  modified_base 7: mod_base = OTHER; note = thymine
  misc_feature 1..23: note = Synthetic
  source 1..23: mol_type = other RNA
attggttacatgaaatcccatcc

SEQ ID NO: 251 - RNA, 21 nt, synthetic construct
  misc_feature 1..21: note = Synthetic
  source 1..21: mol_type = other RNA
tgggatttcatgtaaccaaga

SEQ ID NO: 252 - RNA, 23 nt, synthetic construct
  modified_base 7: mod_base = OTHER; note = thymine
  misc_feature 1..23: note = Synthetic
  source 1..23: mol_type = other RNA
tcttggttacatgaaatcccatc

SEQ ID NO: 253 - RNA, 21 nt, synthetic construct
  misc_feature 1..21: note = Synthetic
  source 1..21: mol_type = other RNA
gggatttcatgtaaccaagat

SEQ ID NO: 254 - RNA, 23 nt, synthetic construct
  modified_base 8: mod_base = OTHER; note = thymine
  misc_feature 1..23: note = Synthetic
  source 1..23: mol_type = other RNA
atcttggttacatgaaatcccat

SEQ ID NO: 255 - RNA, 21 nt, synthetic construct
  misc_feature 1..21: note = Synthetic
  source 1..21: mol_type = other RNA
ggatttcatgtaaccaagagt

SEQ ID NO: 256 - RNA, 23 nt, synthetic construct
  modified_base 6: mod_base = OTHER; note = thymine
  misc_feature 1..23: note = Synthetic
  source 1..23: mol_type = other RNA
actcttggttacatgaaatccca

SEQ ID NO: 257 - RNA, 21 nt, synthetic construct
  misc_feature 1..21: note = Synthetic
  source 1..21: mol_type = other RNA
gatttcatgtaaccaagagta

SEQ ID NO: 258 - RNA, 23 nt, synthetic construct
  modified_base 7: mod_base = OTHER; note = thymine
  misc_feature 1..23: note = Synthetic
  source 1..23: mol_type = other RNA
tactcttggttacatgaaatccc

SEQ ID NO: 259 - RNA, 21 nt, synthetic construct
  misc_feature 1..21: note = Synthetic
  source 1..21: mol_type = other RNA
atttcatgtaaccaagagtat

SEQ ID NO: 260 - RNA, 23 nt, synthetic construct
  modified_base 7: mod_base = OTHER; note = thymine
  misc_feature 1..23: note = Synthetic
  source 1..23: mol_type = other RNA
atactcttggttacatgaaatcc

SEQ ID NO: 261 - RNA, 21 nt, synthetic construct
  misc_feature 1..21: note = Synthetic
  source 1..21: mol_type = other RNA
tttcatgtaaccaagagtatt

SEQ ID NO: 262 - RNA, 23 nt, synthetic construct
  misc_feature 1..23: note = Synthetic
  source 1..23: mol_type = other RNA
aatactcttggttacatgaaatc

SEQ ID NO: 263 - RNA, 21 nt, synthetic construct
  misc_feature 1..21: note = Synthetic
  source 1..21: mol_type = other RNA
ttcatgtaaccaagagtattt

SEQ ID NO: 264 - RNA, 23 nt, synthetic construct
  modified_base 7: mod_base = OTHER; note = thymine
  misc_feature 1..23: note = Synthetic
  source 1..23: mol_type = other RNA
aaatactcttggttacatgaaat

SEQ ID NO: 265 - RNA, 21 nt, synthetic construct
  misc_feature 1..21: note = Synthetic
  source 1..21: mol_type = other RNA
tcatgtaaccaagagtattct

SEQ ID NO: 266 - RNA, 23 nt, synthetic construct
  misc_feature 1..23: note = Synthetic
  source 1..23: mol_type = other RNA
agaatactcttggttacatgaaa

SEQ ID NO: 267 - RNA, 21 nt, synthetic construct
  misc_feature 1..21: note = Synthetic
  source 1..21: mol_type = other RNA
catgtaaccaagagtattcca

SEQ ID NO: 268 - RNA, 23 nt, synthetic construct
  misc_feature 1..23: note = Synthetic
  source 1..23: mol_type = other RNA
tggaatactcttggttacatgaa

SEQ ID NO: 269 - RNA, 21 nt, synthetic construct
  misc_feature 1..21: note = Synthetic
  source 1..21: mol_type = other RNA
atgtaaccaagagtattccat

SEQ ID NO: 270 - RNA, 23 nt, synthetic construct
  modified_base 7: mod_base = OTHER; note = thymine
  misc_feature 1..23: note = Synthetic
  source 1..23: mol_type = other RNA
atggaatactcttggttacatga

SEQ ID NO: 271 - RNA, 21 nt, synthetic construct
  misc_feature 1..21: note = Synthetic
  source 1..21: mol_type = other RNA
tgtaaccaagagtattccatt

SEQ ID NO: 272 - RNA, 23 nt, synthetic construct
  misc_feature 1..23: note = Synthetic
  source 1..23: mol_type = other RNA
aatggaatactcttggttacatg

SEQ ID NO: 273 - RNA, 21 nt, synthetic construct
  misc_feature 1..21: note = Synthetic
  source 1..21: mol_type = other RNA
gtaaccaagagtattccattt

SEQ ID NO: 274 - RNA, 23 nt, synthetic construct
  misc_feature 1..23: note = Synthetic
  source 1..23: mol_type = other RNA
aaatggaatactcttggttacat

SEQ ID NO: 275 - RNA, 21 nt, synthetic construct
  misc_feature 1..21: note = Synthetic
  source 1..21: mol_type = other RNA
taaccaagagtattccatttt

SEQ ID NO: 276 - RNA, 23 nt, synthetic construct
  misc_feature 1..23: note = Synthetic
  source 1..23: mol_type = other RNA
aaaatggaatactcttggttaca

SEQ ID NO: 277 - RNA, 21 nt, synthetic construct
  misc_feature 1..21: note = Synthetic
  source 1..21: mol_type = other RNA
accaagagtattccattttta

SEQ ID NO: 278 - RNA, 23 nt, synthetic construct
  modified_base 7: mod_base = OTHER; note = thymine
  misc_feature 1..23: note = Synthetic
  source 1..23: mol_type = other RNA
taaaaatggaatactcttggtta

SEQ ID NO: 279 - RNA, 21 nt, synthetic construct
  misc_feature 1..21: note = Synthetic
  source 1..21: mol_type = other RNA
ccaagagtattccatttttat

SEQ ID NO: 280 - RNA, 23 nt, synthetic construct
  misc_feature 1..23: note = Synthetic
  source 1..23: mol_type = other RNA
ataaaaatggaatactcttggtt

SEQ ID NO: 281 - RNA, 21 nt, synthetic construct
  misc_feature 1..21: note = Synthetic
  source 1..21: mol_type = other RNA
caagagtattccatttttact

SEQ ID NO: 282 - RNA, 23 nt, synthetic construct
  misc_feature 1..23: note = Synthetic
  source 1..23: mol_type = other RNA
agtaaaaatggaatactcttggt

SEQ ID NO: 283 - RNA, 21 nt, synthetic construct
  misc_feature 1..21: note = Synthetic
  source 1..21: mol_type = other RNA
aagagtattccatttttacta

SEQ ID NO: 284 - RNA, 23 nt, synthetic construct
  misc_feature 1..23: note = Synthetic
  source 1..23: mol_type = other RNA
tagtaaaaatggaatactcttgg

SEQ ID NO: 285 - RNA, 21 nt, synthetic construct
  misc_feature 1..21: note = Synthetic
  source 1..21: mol_type = other RNA
agagtattccatttttactaa

SEQ ID NO: 286 - RNA, 23 nt, synthetic construct
  misc_feature 1..23: note = Synthetic
  source 1..23: mol_type = other RNA
ttagtaaaaatggaatactcttg

SEQ ID NO: 287 - RNA, 21 nt, synthetic construct
  misc_feature 1..21: note = Synthetic
  source 1..21: mol_type = other RNA
gagtattccatttttactaaa

SEQ ID NO: 288 - RNA, 23 nt, synthetic construct
  misc_feature 1..23: note = Synthetic
  source 1..23: mol_type = other RNA
tttagtaaaaatggaatactctt

SEQ ID NO: 289 - RNA, 21 nt, synthetic construct
  misc_feature 1..21: note = Synthetic
  source 1..21: mol_type = other RNA
agtattccatttttactaaat

SEQ ID NO: 290 - RNA, 23 nt, synthetic construct
  modified_base 7: mod_base = OTHER; note = thymine
  misc_feature 1..23: note = Synthetic
  source 1..23: mol_type = other RNA
atttagtaaaaatggaatactct

SEQ ID NO: 291 - RNA, 21 nt, synthetic construct
  misc_feature 1..21: note = Synthetic
  source 1..21: mol_type = other RNA
gtattccatttttactaaagt

SEQ ID NO: 292 - RNA, 23 nt, synthetic construct
  misc_feature 1..23: note = Synthetic
  source 1..23: mol_type = other RNA
actttagtaaaaatggaatactc

SEQ ID NO: 293 - RNA, 21 nt, synthetic construct
  misc_feature 1..21: note = Synthetic
  source 1..21: mol_type = other RNA
tattccatttttactaaagca

SEQ ID NO: 294 - RNA, 23 nt, synthetic construct
  misc_feature 1..23: note = Synthetic
  source 1..23: mol_type = other RNA
tgctttagtaaaaatggaatact

SEQ ID NO: 295 - RNA, 21 nt, synthetic construct
  misc_feature 1..21: note = Synthetic
  source 1..21: mol_type = other RNA
attccatttttactaaagcat

SEQ ID NO: 296 - RNA, 23 nt, synthetic construct
  modified_base 7: mod_base = OTHER; note = thymine
  misc_feature 1..23: note = Synthetic
  source 1..23: mol_type = other RNA
atgctttagtaaaaatggaatac

SEQ ID NO: 297 - RNA, 21 nt, synthetic construct
  misc_feature 1..21: note = Synthetic
  source 1..21: mol_type = other RNA
ttccatttttactaaagcagt

SEQ ID NO: 298 - RNA, 23 nt, synthetic construct
  modified_base 7: mod_base = OTHER; note = thymine
  misc_feature 1..23: note = Synthetic
  source 1..23: mol_type = other RNA
actgctttagtaaaaatggaata

SEQ ID NO: 299 - RNA, 21 nt, synthetic construct
  misc_feature 1..21: note = Synthetic
  source 1..21: mol_type = other RNA
tccatttttactaaagcagtt

SEQ ID NO: 300 - RNA, 23 nt, synthetic construct
  modified_base 7: mod_base = OTHER; note = thymine
  misc_feature 1..23: note = Synthetic
  source 1..23: mol_type = other RNA
aactgctttagtaaaaatggaat

SEQ ID NO: 301 - RNA, 21 nt, synthetic construct
  misc_feature 1..21: note = Synthetic
  source 1..21: mol_type = other RNA
ccatttttactaaagcagtgt

SEQ ID NO: 302 - RNA, 23 nt, synthetic construct
  misc_feature 1..23: note = Synthetic
  source 1..23: mol_type = other RNA
acactgctttagtaaaaatggaa

SEQ ID NO: 303 - RNA, 21 nt, synthetic construct
  misc_feature 1..21: note = Synthetic
  source 1..21: mol_type = other RNA
catttttactaaagcagtgtt

SEQ ID NO: 304 - RNA, 23 nt, synthetic construct
  modified_base 6: mod_base = OTHER; note = thymine
  misc_feature 1..23: note = Synthetic
  source 1..23: mol_type = other RNA
aacactgctttagtaaaaatgga

SEQ ID NO: 305 - RNA, 21 nt, synthetic construct
  misc_feature 1..21: note = Synthetic
  source 1..21: mol_type = other RNA
atttttactaaagcagtgttt

SEQ ID NO: 306 - RNA, 23 nt, synthetic construct
  modified_base 7: mod_base = OTHER; note = thymine
  misc_feature 1..23: note = Synthetic
  source 1..23: mol_type = other RNA
aaacactgctttagtaaaaatgg

SEQ ID NO: 307 - RNA, 21 nt, synthetic construct
  misc_feature 1..21: note = Synthetic
  source 1..21: mol_type = other RNA
tttttactaaagcagtgtttt

SEQ ID NO: 308 - RNA, 23 nt, synthetic construct
  misc_feature 1..23: note = Synthetic
  source 1..23: mol_type = other RNA
aaaacactgctttagtaaaaatg

SEQ ID NO: 309 - RNA, 21 nt, synthetic construct
  misc_feature 1..21: note = Synthetic
  source 1..21: mol_type = other RNA
ttttactaaagcagtgttttt

SEQ ID NO: 310 - RNA, 23 nt, synthetic construct
  misc_feature 1..23: note = Synthetic
  source 1..23: mol_type = other RNA
aaaaacactgctttagtaaaaat

SEQ ID NO: 311 - RNA, 21 nt, synthetic construct
  misc_feature 1..21: note = Synthetic
  source 1..21: mol_type = other RNA
tttactaaagcagtgttttca

SEQ ID NO: 312 - RNA, 23 nt, synthetic construct
  misc_feature 1..23: note = Synthetic
  source 1..23: mol_type = other RNA
tgaaaacactgctttagtaaaaa

SEQ ID NO: 313 - RNA, 21 nt, synthetic construct
  misc_feature 1..21: note = Synthetic
  source 1..21: mol_type = other RNA
ttactaaagcagtgttttcat

SEQ ID NO: 314 - RNA, 23 nt, synthetic construct
  misc_feature 1..23: note = Synthetic
  source 1..23: mol_type = other RNA
atgaaaacactgctttagtaaaa

SEQ ID NO: 315 - RNA, 21 nt, synthetic construct
  misc_feature 1..21: note = Synthetic
  source 1..21: mol_type = other RNA
tactaaagcagtgttttcact

SEQ ID NO: 316 - RNA, 23 nt, synthetic construct
  misc_feature 1..23: note = Synthetic
  source 1..23: mol_type = other RNA
agtgaaaacactgctttagtaaa

SEQ ID NO: 317 - RNA, 21 nt, synthetic construct
  misc_feature 1..21: note = Synthetic
  source 1..21: mol_type = other RNA
actaaagcagtgttttcacct

SEQ ID NO: 318 - RNA, 23 nt, synthetic construct
  misc_feature 1..23: note = Synthetic
  source 1..23: mol_type = other RNA
aggtgaaaacactgctttagtaa

SEQ ID NO: 319 - RNA, 21 nt, synthetic construct
  misc_feature 1..21: note = Synthetic
  source 1..21: mol_type = other RNA
ctaaagcagtgttttcacctt

SEQ ID NO: 320 - RNA, 23 nt, synthetic construct
  misc_feature 1..23: note = Synthetic
  source 1..23: mol_type = other RNA
aaggtgaaaacactgctttagta

SEQ ID NO: 321 - RNA, 21 nt, synthetic construct
  misc_feature 1..21: note = Synthetic
  source 1..21: mol_type = other RNA
taaagcagtgttttcacctca

SEQ ID NO: 322 - RNA, 23 nt, synthetic construct
  modified_base 6: mod_base = OTHER; note = thymine
  misc_feature 1..23: note = Synthetic
  source 1..23: mol_type = other RNA
tgaggtgaaaacactgctttagt

SEQ ID NO: 323 - RNA, 21 nt, synthetic construct
  misc_feature 1..21: note = Synthetic
  source 1..21: mol_type = other RNA
aaagcagtgttttcacctcat

SEQ ID NO: 324 - RNA, 23 nt, synthetic construct
  modified_base 7: mod_base = OTHER; note = thymine
  misc_feature 1..23: note = Synthetic
  source 1..23: mol_type = other RNA
atgaggtgaaaacactgctttag

SEQ ID NO: 325 - RNA, 21 nt, synthetic construct
  misc_feature 1..21: note = Synthetic
  source 1..21: mol_type = other RNA
aagcagtgttttcacctcata

SEQ ID NO: 326 - RNA, 23 nt, synthetic construct
  modified_base 8: mod_base = OTHER; note = thymine
  misc_feature 1..23: note = Synthetic
  source 1..23: mol_type = other RNA
tatgaggtgaaaacactgcttta

SEQ ID NO: 327 - RNA, 21 nt, synthetic construct
  misc_feature 1..21: note = Synthetic
  source 1..21: mol_type = other RNA
agcagtgttttcacctcatat

SEQ ID NO: 328 - RNA, 23 nt, synthetic construct
  misc_feature 1..23: note = Synthetic
  source 1..23: mol_type = other RNA
atatgaggtgaaaacactgcttt

SEQ ID NO: 329 - RNA, 21 nt, synthetic construct
  misc_feature 1..21: note = Synthetic
  source 1..21: mol_type = other RNA
agaagtccaggcagagacaat

SEQ ID NO: 330 - RNA, 23 nt, synthetic construct
  modified_base 7: mod_base = OTHER; note = thymine
  misc_feature 1..23: note = Synthetic
  source 1..23: mol_type = other RNA
attgtctctgcctggacttctaa

SEQ ID NO: 331 - RNA, 21 nt, synthetic construct
  misc_feature 1..21: note = Synthetic
  source 1..21: mol_type = other RNA
gaagtccaggcagagacaata

SEQ ID NO: 332 - RNA, 23 nt, synthetic construct
  misc_feature 1..23: note = Synthetic
  source 1..23: mol_type = other RNA
tattgtctctgcctggacttcta

SEQ ID NO: 333 - RNA, 21 nt, synthetic construct
  misc_feature 1..21: note = Synthetic
  source 1..21: mol_type = other RNA
aagtccaggcagagacaataa

SEQ ID NO: 334 - RNA, 23 nt, synthetic construct
  modified_base 7: mod_base = OTHER; note = thymine
  misc_feature 1..23: note = Synthetic
  source 1..23: mol_type = other RNA
ttattgtctctgcctggacttct

SEQ ID NO: 335 - RNA, 21 nt, synthetic construct
  misc_feature 1..21: note = Synthetic
  source 1..21: mol_type = other RNA
agtccaggcagagacaataaa

SEQ ID NO: 336 - RNA, 23 nt, synthetic construct
  modified_base 6: mod_base = OTHER; note = thymine
  misc_feature 1..23: note = Synthetic
  source 1..23: mol_type = other RNA
tttattgtctctgcctggacttc

SEQ ID NO: 337 - RNA, 21 nt, synthetic construct
  misc_feature 1..21: note = Synthetic
  source 1..21: mol_type = other RNA
gtccaggcagagacaataaaa

SEQ ID NO: 338 - RNA, 23 nt, synthetic construct
  modified_base 7: mod_base = OTHER; note = thymine
  misc_feature 1..23: note = Synthetic
  source 1..23: mol_type = other RNA
ttttattgtctctgcctggactt

SEQ ID NO: 339 - RNA, 21 nt, synthetic construct
  misc_feature 1..21: note = Synthetic
  source 1..21: mol_type = other RNA
tccaggcagagacaataaaat

SEQ ID NO: 340 - RNA, 23 nt, synthetic construct
  modified_base 7: mod_base = OTHER; note = thymine
  misc_feature 1..23: note = Synthetic
  source 1..23: mol_type = other RNA
attttattgtctctgcctggact

SEQ ID NO: 341 - RNA, 21 nt, synthetic construct
  misc_feature 1..21: note = Synthetic
  source 1..21: mol_type = other RNA
ccaggcagagacaataaaaca

SEQ ID NO: 342 - RNA, 23 nt, synthetic construct
  misc_feature 1..23: note = Synthetic
  source 1..23: mol_type = other RNA
tgttttattgtctctgcctggac

SEQ ID NO: 343 - RNA, 21 nt, synthetic construct
  misc_feature 1..21: note = Synthetic
  source 1..21: mol_type = other RNA
caggcagagacaataaaacat

SEQ ID NO: 344 - RNA, 23 nt, synthetic construct
  modified_base 7: mod_base = OTHER; note = thymine
  misc_feature 1..23: note = Synthetic
  source 1..23: mol_type = other RNA
atgttttattgtctctgcctgga

SEQ ID NO: 345 - RNA, 21 nt, synthetic construct
  misc_feature 1..21: note = Synthetic
  source 1..21: mol_type = other RNA
aggcagagacaataaaacatt

SEQ ID NO: 346 - RNA, 23 nt, synthetic construct
  modified_base 7: mod_base = OTHER; note = thymine
  misc_feature 1..23: note = Synthetic
  source 1..23: mol_type = other RNA
aatgttttattgtctctgcctgg

SEQ ID NO: 347 - RNA, 21 nt, synthetic construct
  misc_feature 1..21: note = Synthetic
  source 1..21: mol_type = other RNA
ggcagagacaataaaacattt

SEQ ID NO: 348 - RNA, 23 nt, synthetic construct
  modified_base 7: mod_base = OTHER; note = thymine
  misc_feature 1..23: note = Synthetic
  source 1..23: mol_type = other RNA
aaatgttttattgtctctgcctg

SEQ ID NO: 349 - RNA, 21 nt, synthetic construct
  misc_feature 1..21: note = Synthetic
  source 1..21: mol_type = other RNA
gcagagacaataaaacattct

SEQ ID NO: 350 - RNA, 23 nt, synthetic construct
  modified_base 7: mod_base = OTHER; note = thymine
  misc_feature 1..23: note = Synthetic
  source 1..23: mol_type = other RNA
agaatgttttattgtctctgcct

SEQ ID NO: 351 - RNA, 21 nt, synthetic construct
  misc_feature 1..21: note = Synthetic
  source 1..21: mol_type = other RNA
agagacaataaaacattcctt

SEQ ID NO: 352 - RNA, 23 nt, synthetic construct
  modified_base 7: mod_base = OTHER; note = thymine
  misc_feature 1..23: note = Synthetic
  source 1..23: mol_type = other RNA
aaggaatgttttattgtctctgc

SEQ ID NO: 353 - RNA, 21 nt, synthetic construct
  misc_feature 1..21: note = Synthetic
  source 1..21: mol_type = other RNA
gagacaataaaacattcctgt

SEQ ID NO: 354 - RNA, 23 nt, synthetic construct
  misc_feature 1..23: note = Synthetic
  source 1..23: mol_type = other RNA
acaggaatgttttattgtctctg

SEQ ID NO: 355 - RNA, 21 nt, synthetic construct
  misc_feature 1..21: note = Synthetic
  source 1..21: mol_type = other RNA
gacaataaaacattcctgtga

SEQ ID NO: 356 - RNA, 23 nt, synthetic construct
  misc_feature 1..23: note = Synthetic
  source 1..23: mol_type = other RNA
tcacaggaatgttttattgtctc

SEQ ID NO: 357 - RNA, 21 nt, synthetic construct
  misc_feature 1..21: note = Synthetic
  source 1..21: mol_type = other RNA
acaataaaacattcctgtgaa

SEQ ID NO: 358 - RNA, 23 nt, synthetic construct
  misc_feature 1..23: note = Synthetic
  source 1..23: mol_type = other RNA
ttcacaggaatgttttattgtct

SEQ ID NO: 359 - RNA, 21 nt, synthetic construct
  misc_feature 1..21: note = Synthetic
  source 1..21: mol_type = other RNA
caataaaacattcctgtgaaa

SEQ ID NO: 360 - RNA, 23 nt, synthetic construct
  misc_feature 1..23: note = Synthetic
  source 1..23: mol_type = other RNA
tttcacaggaatgttttattgtc

SEQ ID NO: 361 - RNA, 21 nt, synthetic construct
  misc_feature 1..21: note = Synthetic
  source 1..21: mol_type = other RNA
aataaaacattcctgtgaaat

SEQ ID NO: 362 - RNA, 23 nt, synthetic construct
  misc_feature 1..23: note = Synthetic
  source 1..23: mol_type = other RNA
atttcacaggaatgttttattgt

SEQ ID NO: 363 - RNA, 21 nt, synthetic construct
  misc_feature 1..21: note = Synthetic
  source 1..21: mol_type = other RNA
ataaaacattcctgtgaaagt

SEQ ID NO: 364 - RNA, 23 nt, synthetic construct
  misc_feature 1..23: note = Synthetic
  source 1..23: mol_type = other RNA
actttcacaggaatgttttattg

SEQ ID NO: 365 - RNA, 21 nt, synthetic construct
  misc_feature 1..21: note = Synthetic
  source 1..21: mol_type = other RNA
aaaacattcctgtgaaaggca

SEQ ID NO: 366 - RNA, 23 nt, synthetic construct
  modified_base 7: mod_base = OTHER; note = thymine
  misc_feature 1..23: note = Synthetic
  source 1..23: mol_type = other RNA
tgcctttcacaggaatgttttat

SEQ ID NO: 367 - RNA, 21 nt, synthetic construct
  misc_feature 1..21: note = Synthetic
  source 1..21: mol_type = other RNA
aaacattcctgtgaaaggcat

SEQ ID NO: 368 - RNA, 23 nt, synthetic construct
  modified_base 7: mod_base = OTHER; note = thymine
  misc_feature 1..23: note = Synthetic
  source 1..23: mol_type = other RNA
atgcctttcacaggaatgtttta

SEQ ID NO: 369 - RNA, 21 nt, synthetic construct
  misc_feature 1..21: note = Synthetic
  source 1..21: mol_type = other RNA
aacattcctgtgaaaggcact

SEQ ID NO: 370 - RNA, 23 nt, synthetic construct
  modified_base 7: mod_base = OTHER; note = thymine
  misc_feature 1..23: note = Synthetic
  source 1..23: mol_type = other RNA
agtgcctttcacaggaatgtttt

SEQ ID NO: 371 - RNA, 21 nt, synthetic construct
  misc_feature 1..21: note = Synthetic
  source 1..21: mol_type = other RNA
acattcctgtgaaaggcactt

SEQ ID NO: 372 - RNA, 23 nt, synthetic construct
  misc_feature 1..23: note = Synthetic
  source 1..23: mol_type = other RNA
aagtgcctttcacaggaatgttt

SEQ ID NO: 373 - RNA, 21 nt, synthetic construct
  misc_feature 1..21: note = Synthetic
  source 1..21: mol_type = other RNA
cattcctgtgaaaggcacttt

SEQ ID NO: 374 - RNA, 23 nt, synthetic construct
  misc_feature 1..23: note = Synthetic
  source 1..23: mol_type = other RNA
aaagtgcctttcacaggaatgtt

SEQ ID NO: 375 - RNA, 21 nt, synthetic construct
  misc_feature 1..21: note = Synthetic
  source 1..21: mol_type = other RNA
attcctgtgaaaggcactttt

SEQ ID NO: 376 - RNA, 23 nt, synthetic construct
  modified_base 6: mod_base = OTHER; note = thymine
  misc_feature 1..23: note = Synthetic
  source 1..23: mol_type = other RNA
aaaagtgcctttcacaggaatgt

SEQ ID NO: 377 - RNA, 21 nt, synthetic construct
  misc_feature 1..21: note = Synthetic
  source 1..21: mol_type = other RNA
ttcctgtgaaaggcacttttt

SEQ ID NO: 378 - RNA, 23 nt, synthetic construct
  modified_base 7: mod_base = OTHER; note = thymine
  misc_feature 1..23: note = Synthetic
  source 1..23: mol_type = other RNA
aaaaagtgcctttcacaggaatg

SEQ ID NO: 379 - RNA, 21 nt, synthetic construct
  misc_feature 1..21: note = Synthetic
  source 1..21: mol_type = other RNA
tcctgtgaaaggcacttttca

SEQ ID NO: 380 - RNA, 23 nt, synthetic construct
  misc_feature 1..23: note = Synthetic
  source 1..23: mol_type = other RNA
tgaaaagtgcctttcacaggaat

SEQ ID NO: 381 - RNA, 21 nt, synthetic construct
  misc_feature 1..21: note = Synthetic
  source 1..21: mol_type = other RNA
cctgtgaaaggcacttttcat

SEQ ID NO: 382 - RNA, 23 nt, synthetic construct
  misc_feature 1..23: note = Synthetic
  source 1..23: mol_type = other RNA
atgaaaagtgcctttcacaggaa

SEQ ID NO: 383 - RNA, 21 nt, synthetic construct
  misc_feature 1..21: note = Synthetic
  source 1..21: mol_type = other RNA
ctgtgaaaggcacttttcatt

SEQ ID NO: 384 - RNA, 23 nt, synthetic construct
  misc_feature 1..23: note = Synthetic
  source 1..23: mol_type = other RNA
aatgaaaagtgcctttcacagga

SEQ ID NO: 385 - RNA, 21 nt, synthetic construct
  misc_feature 1..21: note = Synthetic
  source 1..21: mol_type = other RNA
tgtgaaaggcacttttcattt

SEQ ID NO: 386 - RNA, 23 nt, synthetic construct
  misc_feature 1..23: note = Synthetic
  source 1..23: mol_type = other RNA
aaatgaaaagtgcctttcacagg

SEQ ID NO: 387 - RNA, 21 nt, synthetic construct
  misc_feature 1..21: note = Synthetic
  source 1..21: mol_type = other RNA
gtgaaaggcacttttcattct

SEQ ID NO: 388 - RNA, 23 nt, synthetic construct
  misc_feature 1..23: note = Synthetic
  source 1..23: mol_type = other RNA
agaatgaaaagtgcctttcacag

SEQ ID NO: 389 - RNA, 21 nt, synthetic construct
  misc_feature 1..21: note = Synthetic
  source 1..21: mol_type = other RNA
tgaaaggcacttttcattcca

SEQ ID NO: 390 - RNA, 23 nt, synthetic construct
  modified_base 6: mod_base = OTHER; note = thymine
  misc_feature 1..23: note = Synthetic
  source 1..23: mol_type = other RNA
tggaatgaaaagtgcctttcaca

SEQ ID NO: 391 - RNA, 21 nt, synthetic construct
  misc_feature 1..21: note = Synthetic
  source 1..21: mol_type = other RNA
gaaaggcacttttcattccat

SEQ ID NO: 392 - RNA, 23 nt, synthetic construct
  modified_base 7: mod_base = OTHER; note = thymine
  misc_feature 1..23: note = Synthetic
  source 1..23: mol_type = other RNA
atggaatgaaaagtgcctttcac

SEQ ID NO: 393 - RNA, 21 nt, synthetic construct
  misc_feature 1..21: note = Synthetic
  source 1..21: mol_type = other RNA
tgtaaccaagagtattccatt

SEQ ID NO: 394 - RNA, 23 nt, synthetic construct
  misc_feature 1..23: note = Synthetic
  source 1..23: mol_type = other RNA
aatggaatactcttggttacatg

SEQ ID NO: 395 - RNA, 21 nt, synthetic construct
  misc_feature 1..21: note = Synthetic
  source 1..21: mol_type = other RNA
aaccaagagtattccattttt

SEQ ID NO: 396 - RNA, 23 nt, synthetic construct
  misc_feature 1..23: note = Synthetic
  source 1..23: mol_type = other RNA
aaaaatggaatactcttggttac

SEQ ID NO: 397 - RNA, 21 nt, synthetic construct
  misc_feature 1..21: note = Synthetic
  source 1..21: mol_type = other RNA
cagagacaataaaacattcct

SEQ ID NO: 398 - RNA, 23 nt, synthetic construct
  misc_feature 1..23: note = Synthetic
  source 1..23: mol_type = other RNA
aggaatgttttattgtctctgcc

SEQ ID NO: 399 - RNA, 21 nt, synthetic construct
  misc_feature 1..21: note = Synthetic
  source 1..21: mol_type = other RNA
tttttactaaagcagtgtttt

SEQ ID NO: 400 - RNA, 23 nt, synthetic construct
  misc_feature 1..23: note = Synthetic
  source 1..23: mol_type = other RNA
aaaacactgctttagtaaaaatg

SEQ ID NO: 401 - RNA, 21 nt, synthetic construct
  misc_feature 1..21: note = Synthetic
  source 1..21: mol_type = other RNA
tttcatgtaaccaagagtatt

SEQ ID NO: 402 - RNA, 23 nt, synthetic construct
  misc_feature 1..23: note = Synthetic
  source 1..23: mol_type = other RNA
aatactcttggttacatgaaatc

SEQ ID NO: 403 - RNA, 21 nt, synthetic construct
  misc_feature 1..21: note = Synthetic
  source 1..21: mol_type = other RNA
caataaaacattcctgtgaaa

SEQ ID NO: 404 - RNA, 23 nt, synthetic construct
  misc_feature 1..23: note = Synthetic
  source 1..23: mol_type = other RNA
tttcacaggaatgttttattgtc

SEQ ID NO: 405 - RNA, 21 nt, synthetic construct
  misc_feature 1..21: note = Synthetic
  source 1..21: mol_type = other RNA
aaccaagagtattccattttt

SEQ ID NO: 406 - RNA, 23 nt, synthetic construct
  modified_base 6: mod_base = OTHER; note = thymine
  misc_feature 1..23: note = Synthetic
  source 1..23: mol_type = other RNA
aaaaatggaatactcttggttac

SEQ ID NO: 407 - RNA, 21 nt, synthetic construct
  misc_feature 1..21: note = Synthetic
  source 1..21: mol_type = other RNA
cagagacaataaaacattcct

SEQ ID NO: 408 - RNA, 23 nt, synthetic construct
  modified_base 6: mod_base = OTHER; note = thymine
  misc_feature 1..23: note = Synthetic
  source 1..23: mol_type = other RNA
aggaatgttttattgtctctgcc

SEQ ID NO: 409 - RNA, 21 nt, synthetic construct
  misc_feature 1..21: note = Synthetic
  source 1..21: mol_type = other RNA
tgggatttcatgtaaccaaga

SEQ ID NO: 410 - RNA, 23 nt, synthetic construct
  misc_feature 1..23: note = Synthetic
  source 1..23: mol_type = other RNA
tcttggttacatgaaatcccatc

SEQ ID NO: 411 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluoroguanosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ctgaaggacgagggatgggat

SEQ ID NO: 412 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  source 1..23: mol_type = other RNA
atcccatccctcgtccttcaggt

SEQ ID NO: 413 - RNA, 23 nt, synthetic construct
  misc_feature 1..23: note = Synthetic
  source 1..23: mol_type = other RNA
acctgaaggacgagggatgggat

SEQ ID NO: 414 - RNA, 21 nt, synthetic construct
  misc_feature 1..21: note = Synthetic
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tgaaggacgagggatgggatt

SEQ ID NO: 415 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  source 1..23: mol_type = other RNA
aatcccatccctcgtccttcagg

SEQ ID NO: 416 - RNA, 23 nt, synthetic construct
  misc_feature 1..23: note = Synthetic
  source 1..23: mol_type = other RNA
cctgaaggacgagggatgggatt

SEQ ID NO: 417 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gaaggacgagggatgggattt

SEQ ID NO: 418 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  source 1..23: mol_type = other RNA
aaatcccatccctcgtccttcag

SEQ ID NO: 419 - RNA, 23 nt, synthetic construct
  misc_feature 1..23: note = Synthetic
  source 1..23: mol_type = other RNA
ctgaaggacgagggatgggattt

SEQ ID NO: 420 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
aaggacgagggatgggatttt

SEQ ID NO: 421 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
aaaatcccatccctcgtccttca

SEQ ID NO: 422 - RNA, 23 nt, synthetic construct
  misc_feature 1..23: note = Synthetic
  source 1..23: mol_type = other RNA
tgaaggacgagggatgggatttc

SEQ ID NO: 423 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aggacgagggatgggatttca

SEQ ID NO: 424 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  source 1..23: mol_type = other RNA
tgaaatcccatccctcgtccttc

SEQ ID NO: 425 - RNA, 23 nt, synthetic construct
  misc_feature 1..23: note = Synthetic
  source 1..23: mol_type = other RNA
gaaggacgagggatgggatttca

SEQ ID NO: 426 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ggacgagggatgggatttcat

SEQ ID NO: 427 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methylcytidine-3'- phosphorothioate
  modified_base 22: mod_base = OTHER; note = 2'-O-methyluridine-3'- phosphorothioate
  source 1..23: mol_type = other RNA
atgaaatcccatccctcgtcctt

SEQ ID NO: 428 - RNA, 23 nt, synthetic construct
  misc_feature 1..23: note = Synthetic
  source 1..23: mol_type = other RNA
aaggacgagggatgggatttcat

SEQ ID NO: 429 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gacgagggatgggatttcatt

SEQ ID NO: 430 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  source 1..23: mol_type = other RNA
aatgaaatcccatccctcgtcct

SEQ ID NO: 431 - RNA, 23 nt, synthetic construct
  misc_feature 1..23: note = Synthetic
  source 1..23: mol_type = other RNA
aggacgagggatgggatttcatg

SEQ ID NO: 432 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
acgagggatgggatttcatgt

SEQ ID NO: 433 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
acatgaaatcccatccctcgtcc

SEQ ID NO: 434 - RNA, 23 nt, synthetic construct
  misc_feature 1..23: note = Synthetic
  source 1..23: mol_type = other RNA
ggacgagggatgggatttcatgt

SEQ ID NO: 435 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylguanosine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
cgagggatgggatttcatgta

SEQ ID NO: 436 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 14: mod_base = OTHER; note = 2'-fluoroadenosine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
tacatgaaatcccatccctcgtc

SEQ ID NO: 437 - RNA, 23 nt, synthetic construct
  misc_feature 1..23: note = Synthetic
  source 1..23: mol_type = other RNA
gacgagggatgggatttcatgta

SEQ ID NO: 438 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gagggatgggatttcatgtaa

SEQ ID NO: 439 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluorouridine-3'-phosphate
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'- phosphorothioate
  source 1..23: mol_type = other RNA
ttacatgaaatcccatccctcgt

SEQ ID NO: 440 - RNA, 23 nt, synthetic construct
  misc_feature 1..23: note = Synthetic
  source 1..23: mol_type = other RNA
acgagggatgggatttcatgtaa

SEQ ID NO: 441 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
agggatgggatttcatgtaat

SEQ ID NO: 442 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 14: mod_base = OTHER; note = 2'-fluorocytidine-3'-phosphate
  modified_base 16: mod_base = OTHER; note = 2'-fluoroadenosine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
attacatgaaatcccatccctcg

SEQ ID NO: 443 - RNA, 23 nt, synthetic construct
  misc_feature 1..23: note = Synthetic
  source 1..23: mol_type = other RNA
cgagggatgggatttcatgtaac

SEQ ID NO: 444 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gggatgggatttcatgtaact

SEQ ID NO: 445 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluorocytidine-3'-phosphate
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
agttacatgaaatcccatccctc

SEQ ID NO: 446 - RNA, 23 nt, synthetic construct
  misc_feature 1..23: note = Synthetic
  source 1..23: mol_type = other RNA
gagggatgggatttcatgtaacc

SEQ ID NO: 447 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ggatgggatttcatgtaacca

SEQ ID NO: 448 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  source 1..23: mol_type = other RNA
tggttacatgaaatcccatccct

SEQ ID NO: 449 - RNA, 23 nt, synthetic construct
  misc_feature 1..23: note = Synthetic
  source 1..23: mol_type = other RNA
agggatgggatttcatgtaacca

SEQ ID NO: 450 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gatgggatttcatgtaaccaa

SEQ ID NO: 451 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluorouridine-3'-phosphate
  modified_base 14: mod_base = OTHER; note = 2'-fluoroadenosine-3'-phosphate
  modified_base 16: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
ttggttacatgaaatcccatccc

SEQ ID NO: 452 - RNA, 23 nt, synthetic construct
  misc_feature 1..23: note = Synthetic
  source 1..23: mol_type = other RNA
gggatgggatttcatgtaaccaa

SEQ ID NO: 453 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
atgggatttcatgtaaccaat

SEQ ID NO: 454 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluorouridine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
attggttacatgaaatcccatcc

SEQ ID NO: 455 - RNA, 23 nt, synthetic construct
  misc_feature 1..23: note = Synthetic
  source 1..23: mol_type = other RNA
ggatgggatttcatgtaaccaag

SEQ ID NO: 456 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gggatttcatgtaaccaagat

SEQ ID NO: 457 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroguanosine-3'-phosphate
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  source 1..23: mol_type = other RNA
atcttggttacatgaaatcccat

SEQ ID NO: 458 - RNA, 23 nt, synthetic construct
  misc_feature 1..23: note = Synthetic
  source 1..23: mol_type = other RNA
atgggatttcatgtaaccaagag

SEQ ID NO: 459 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'-phosphorothioate
  modified_base 7: mod_base = OTHER; note = 2'-fluorocytdine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ggatttcatgtaaccaagagt

SEQ ID NO: 460 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = 2'-fluorouridine-3'-phosphate
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
actcttggttacatgaaatccca

SEQ ID NO: 461 - RNA, 23 nt, synthetic construct
  misc_feature 1..23: note = Synthetic
  source 1..23: mol_type = other RNA
tgggatttcatgtaaccaagagt

SEQ ID NO: 462 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gatttcatgtaaccaagagta

SEQ ID NO: 463 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 6: mod_base = OTHER; note = 2'-fluorouridine-3'-phosphate
  modified_base 14: mod_base = OTHER; note = 2'-fluoroadenosine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
tactcttggttacatgaaatccc

SEQ ID NO: 464 - RNA, 23 nt, synthetic construct
  misc_feature 1..23: note = Synthetic
  source 1..23: mol_type = other RNA
gggatttcatgtaaccaagagta

SEQ ID NO: 465 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
atttcatgtaaccaagagtat

SEQ ID NO: 466 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluorocytidine-3'-phosphate
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
atactcttggttacatgaaatcc

SEQ ID NO: 467 - RNA, 23 nt, synthetic construct
  misc_feature 1..23: note = Synthetic
  source 1..23: mol_type = other RNA
ggatttcatgtaaccaagagtat

SEQ ID NO: 468 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ttcatgtaaccaagagtattt

SEQ ID NO: 469 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  source 1..23: mol_type = other RNA
aaatactcttggttacatgaaat

SEQ ID NO: 470 - RNA, 23 nt, synthetic construct
  misc_feature 1..23: note = Synthetic
  source 1..23: mol_type = other RNA
atttcatgtaaccaagagtattc

SEQ ID NO: 471 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
catgtaaccaagagtattcca

SEQ ID NO: 472 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  source 1..23: mol_type = other RNA
tggaatactcttggttacatgaa

SEQ ID NO: 473 - RNA, 23 nt, synthetic construct
  misc_feature 1..23: note = Synthetic
  source 1..23: mol_type = other RNA
ttcatgtaaccaagagtattcca

SEQ ID NO: 474 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
atgtaaccaagagtattccat

SEQ ID NO: 475 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluoroadenosine-3'-phosphate
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
atggaatactcttggttacatga

SEQ ID NO: 476 - RNA, 23 nt, synthetic construct
  misc_feature 1..23: note = Synthetic
  source 1..23: mol_type = other RNA
tcatgtaaccaagagtattccat

SEQ ID NO: 477 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gtaaccaagagtattccattt

SEQ ID NO: 478 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  source 1..23: mol_type = other RNA
aaatggaatactcttggttacat

SEQ ID NO: 479 - RNA, 23 nt, synthetic construct
  misc_feature 1..23: note = Synthetic
  source 1..23: mol_type = other RNA
atgtaaccaagagtattccattt

SEQ ID NO: 480 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
taaccaagagtattccatttt

SEQ ID NO: 481 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  source 1..23: mol_type = other RNA
aaaatggaatactcttggttaca

SEQ ID NO: 482 - RNA, 23 nt, synthetic construct
  misc_feature 1..23: note = Synthetic
  source 1..23: mol_type = other RNA
tgtaaccaagagtattccatttt

SEQ ID NO: 483 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
accaagagtattccattttta

SEQ ID NO: 484 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
taaaaatggaatactcttggtta

SEQ ID NO: 485 - RNA, 23 nt, synthetic construct
  misc_feature 1..23: note = Synthetic
  source 1..23: mol_type = other RNA
taaccaagagtattccattttta

SEQ ID NO: 486 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 487 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 488 - RNA, 23 nt, synthetic construct
  misc_feature 1..23: note = Synthetic
  source 1..23: mol_type = other RNA
aaccaagagtattccatttttac

SEQ ID NO: 489 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 490 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 491 - RNA, 23 nt, synthetic construct
  misc_feature 1..23: note = Synthetic
  source 1..23: mol_type = other RNA
accaagagtattccatttttact

SEQ ID NO: 492 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
aagagtattccatttttacta

SEQ ID NO: 493 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
tagtaaaaatggaatactcttgg

SEQ ID NO: 494 - RNA, 23 nt, synthetic construct
  misc_feature 1..23: note = Synthetic
  source 1..23: mol_type = other RNA
ccaagagtattccatttttacta

SEQ ID NO: 495 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactaa

SEQ ID NO: 496 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
ttagtaaaaatggaatactcttg

SEQ ID NO: 497 - RNA, 23 nt, synthetic construct
  misc_feature 1..23: note = Synthetic
  source 1..23: mol_type = other RNA
caagagtattccatttttactaa

SEQ ID NO: 498 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gagtattccatttttactaaa

SEQ ID NO: 499 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluorouridine-3'-phosphate
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
tttagtaaaaatggaatactctt

SEQ ID NO: 500 - RNA, 23 nt, synthetic construct
  misc_feature 1..23: note = Synthetic
  source 1..23: mol_type = other RNA
aagagtattccatttttactaaa

SEQ ID NO: 501 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
agtattccatttttactaaat

SEQ ID NO: 502 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluoroguanosine-3'-phosphate
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
atttagtaaaaatggaatactct

SEQ ID NO: 503 - RNA, 23 nt, synthetic construct
  misc_feature 1..23: note = Synthetic
  source 1..23: mol_type = other RNA
agagtattccatttttactaaag

SEQ ID NO: 504 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gtattccatttttactaaagt

SEQ ID NO: 505 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
actttagtaaaaatggaatactc

SEQ ID NO: 506 - RNA, 23 nt, synthetic construct
  misc_feature 1..23: note = Synthetic
  source 1..23: mol_type = other RNA
gagtattccatttttactaaagc

SEQ ID NO: 507 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
tattccatttttactaaagca

SEQ ID NO: 508 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 14: mod_base = OTHER; note = 2'-fluoroadenosine-3'-phosphate
  modified_base 16: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  source 1..23: mol_type = other RNA
tgctttagtaaaaatggaatact

SEQ ID NO: 509 - RNA, 23 nt, synthetic construct
  misc_feature 1..23: note = Synthetic
  source 1..23: mol_type = other RNA
agtattccatttttactaaagca

SEQ ID NO: 510 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
attccatttttactaaagcat

SEQ ID NO: 511 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluorouridine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  source 1..23: mol_type = other RNA
atgctttagtaaaaatggaatac

SEQ ID NO: 512 - RNA, 23 nt, synthetic construct
  misc_feature 1..23: note = Synthetic
  source 1..23: mol_type = other RNA
gtattccatttttactaaagcag

SEQ ID NO: 513 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ttccatttttactaaagcagt

SEQ ID NO: 514 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = 2'-fluorouridine-3'-phosphate
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'- phosphorothioate
  source 1..23: mol_type = other RNA
actgctttagtaaaaatggaata

SEQ ID NO: 515 - RNA, 23 nt, synthetic construct
  misc_feature 1..23: note = Synthetic
  source 1..23: mol_type = other RNA
tattccatttttactaaagcagt

SEQ ID NO: 516 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'-phosphorothioate
  modified_base 7: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccatttttactaaagcagtgt

SEQ ID NO: 517 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = 2'-fluoroguanosine-3'-phosphate
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'- phosphorothioate
  source 1..23: mol_type = other RNA
acactgctttagtaaaaatggaa

SEQ ID NO: 518 - RNA, 23 nt, synthetic construct
  misc_feature 1..23: note = Synthetic
  source 1..23: mol_type = other RNA
ttccatttttactaaagcagtgt

SEQ ID NO: 519 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
catttttactaaagcagtgtt

SEQ ID NO: 520 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorouridine-3'-phosphate
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  source 1..23: mol_type = other RNA
aacactgctttagtaaaaatgga

SEQ ID NO: 521 - RNA, 23 nt, synthetic construct
  misc_feature 1..23: note = Synthetic
  source 1..23: mol_type = other RNA
tccatttttactaaagcagtgtt

SEQ ID NO: 522 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
atttttactaaagcagtgttt

SEQ ID NO: 523 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'- phosphorothioate
  modified_base 22: mod_base = OTHER; note = 2'-O-methylguanosine-3'- phosphorothioate
  source 1..23: mol_type = other RNA
aaacactgctttagtaaaaatgg

SEQ ID NO: 524 - RNA, 23 nt, synthetic construct
  misc_feature 1..23: note = Synthetic
  source 1..23: mol_type = other RNA
ccatttttactaaagcagtgttt

SEQ ID NO: 525 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ttttactaaagcagtgttttt

SEQ ID NO: 526 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  source 1..23: mol_type = other RNA
aaaaacactgctttagtaaaaat

SEQ ID NO: 527 - RNA, 23 nt, synthetic construct
  misc_feature 1..23: note = Synthetic
  source 1..23: mol_type = other RNA
atttttactaaagcagtgttttc

SEQ ID NO: 528 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tttactaaagcagtgttttca

SEQ ID NO: 529 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  source 1..23: mol_type = other RNA
tgaaaacactgctttagtaaaaa

SEQ ID NO: 530 - RNA, 23 nt, synthetic construct
  misc_feature 1..23: note = Synthetic
  source 1..23: mol_type = other RNA
tttttactaaagcagtgttttca

SEQ ID NO: 531 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ttactaaagcagtgttttcat

SEQ ID NO: 532 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'- phosphorothioate
  source 1..23: mol_type = other RNA
atgaaaacactgctttagtaaaa

SEQ ID NO: 533 - RNA, 23 nt, synthetic construct
  misc_feature 1..23: note = Synthetic
  source 1..23: mol_type = other RNA
ttttactaaagcagtgttttcac

SEQ ID NO: 534 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorguanosine-3'-phosphate
  modified_base 21: mod_base = OTHER; note = L96
  source 1..21: mol_type = other RNA
tactaaagcagtgttttcact

SEQ ID NO: 535 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'- phosphorothioate
  source 1..23: mol_type = other RNA
agtgaaaacactgctttagtaaa

SEQ ID NO: 536 - RNA, 23 nt, synthetic construct
  misc_feature 1..23: note = Synthetic
  source 1..23: mol_type = other RNA
tttactaaagcagtgttttcacc

SEQ ID NO: 537 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
actaaagcagtgttttcacct

SEQ ID NO: 538 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  source 1..23: mol_type = other RNA
aggtgaaaacactgctttagtaa

SEQ ID NO: 539 - RNA, 23 nt, synthetic construct
  misc_feature 1..23: note = Synthetic
  source 1..23: mol_type = other RNA
ttactaaagcagtgttttcacct

SEQ ID NO: 540 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ctaaagcagtgttttcacctt

SEQ ID NO: 541 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
aaggtgaaaacactgctttagta

SEQ ID NO: 542 - RNA, 23 nt, synthetic construct
  misc_feature 1..23: note = Synthetic
  source 1..23: mol_type = other RNA
tactaaagcagtgttttcacctc

SEQ ID NO: 543 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
taaagcagtgttttcacctca

SEQ ID NO: 544 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  source 1..23: mol_type = other RNA
tgaggtgaaaacactgctttagt

SEQ ID NO: 545 - RNA, 23 nt, synthetic construct
  misc_feature 1..23: note = Synthetic
  source 1..23: mol_type = other RNA
actaaagcagtgttttcacctca

SEQ ID NO: 546 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aaagcagtgttttcacctcat

SEQ ID NO: 547 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluoroguanosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  source 1..23: mol_type = other RNA
atgaggtgaaaacactgctttag

SEQ ID NO: 548 - RNA, 23 nt, synthetic construct
  misc_feature 1..23: note = Synthetic
  source 1..23: mol_type = other RNA
ctaaagcagtgttttcacctcat

SEQ ID NO: 549 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aagcagtgttttcacctcata

SEQ ID NO: 550 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
tatgaggtgaaaacactgcttta

SEQ ID NO: 551 - RNA, 23 nt, synthetic construct
  misc_feature 1..23: note = Synthetic
  source 1..23: mol_type = other RNA
taaagcagtgttttcacctcata

SEQ ID NO: 552 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
agcagtgttttcacctcatat

SEQ ID NO: 553 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluoroguanosine-3'-phosphate
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
atatgaggtgaaaacactgcttt

SEQ ID NO: 554 - RNA, 23 nt, synthetic construct
  misc_feature 1..23: note = Synthetic
  source 1..23: mol_type = other RNA
aaagcagtgttttcacctcatat

SEQ ID NO: 555 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
agaagtccaggcagagacaat

SEQ ID NO: 556 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluorocytidine-3'-phosphate
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  source 1..23: mol_type = other RNA
attgtctctgcctggacttctaa

SEQ ID NO: 557 - RNA, 23 nt, synthetic construct
  misc_feature 1..23: note = Synthetic
  source 1..23: mol_type = other RNA
ttagaagtccaggcagagacaat

SEQ ID NO: 558 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluorocytidine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gaagtccaggcagagacaata

SEQ ID NO: 559 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 6: mod_base = OTHER; note = 2'-fluorouridine-3'-phosphate
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
tattgtctctgcctggacttcta

SEQ ID NO: 560 - RNA, 23 nt, synthetic construct
  misc_feature 1..23: note = Synthetic
  source 1..23: mol_type = other RNA
tagaagtccaggcagagacaata

SEQ ID NO: 561 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
agtccaggcagagacaataaa

SEQ ID NO: 562 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluorouridine-3'-phosphate
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
tttattgtctctgcctggacttc

SEQ ID NO: 563 - RNA, 23 nt, synthetic construct
  misc_feature 1..23: note = Synthetic
  source 1..23: mol_type = other RNA
gaagtccaggcagagacaataaa

SEQ ID NO: 564 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gtccaggcagagacaataaaa

SEQ ID NO: 565 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluorouridine-3'-phosphate
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
ttttattgtctctgcctggactt

SEQ ID NO: 566 - RNA, 23 nt, synthetic construct
  misc_feature 1..23: note = Synthetic
  source 1..23: mol_type = other RNA
aagtccaggcagagacaataaaa

SEQ ID NO: 567 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'-phosphorothioate
  modified_base 7: mod_base = OTHER; note = 2'-fluorocytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tccaggcagagacaataaaat

SEQ ID NO: 568 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
attttattgtctctgcctggact

SEQ ID NO: 569 - RNA, 23 nt, synthetic construct
  misc_feature 1..23: note = Synthetic
  source 1..23: mol_type = other RNA
agtccaggcagagacaataaaac

SEQ ID NO: 570 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ccaggcagagacaataaaaca

SEQ ID NO: 571 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  source 1..23: mol_type = other RNA
tgttttattgtctctgcctggac

SEQ ID NO: 572 - RNA, 23 nt, synthetic construct
  misc_feature 1..23: note = Synthetic
  source 1..23: mol_type = other RNA
gtccaggcagagacaataaaaca

SEQ ID NO: 573 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caggcagagacaataaaacat

SEQ ID NO: 574 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluorouridine-3'-phosphate
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
atgttttattgtctctgcctgga

SEQ ID NO: 575 - RNA, 23 nt, synthetic construct
  misc_feature 1..23: note = Synthetic
  source 1..23: mol_type = other RNA
tccaggcagagacaataaaacat

SEQ ID NO: 576 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aggcagagacaataaaacatt

SEQ ID NO: 577 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorouridine-3'-phosphate
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methyluridine-3'- phosphorothioate
  modified_base 22: mod_base = OTHER; note = 2'-O-methylguanosine-3'- phosphorothioate
  source 1..23: mol_type = other RNA
aatgttttattgtctctgcctgg

SEQ ID NO: 578 - RNA, 23 nt, synthetic construct
  misc_feature 1..23: note = Synthetic
  source 1..23: mol_type = other RNA
ccaggcagagacaataaaacatt

SEQ ID NO: 579 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ggcagagacaataaaacattt

SEQ ID NO: 580 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorouridine-3'-phosphate
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylcytidine-3'- phosphorothioate
  modified_base 22: mod_base = OTHER; note = 2'-O-methyluridine-3'- phosphorothioate
  source 1..23: mol_type = other RNA
aaatgttttattgtctctgcctg

SEQ ID NO: 581 - RNA, 23 nt, synthetic construct
  misc_feature 1..23: note = Synthetic
  source 1..23: mol_type = other RNA
caggcagagacaataaaacattc

SEQ ID NO: 582 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gcagagacaataaaacattct

SEQ ID NO: 583 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroguanosine-3'-phosphate
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agaatgttttattgtctctgcct

SEQ ID NO: 584 - RNA, 23 nt, synthetic construct
  misc_feature 1..23: note = Synthetic
  source 1..23: mol_type = other RNA
aggcagagacaataaaacattcc

SEQ ID NO: 585 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagacaataaaacattcctt

SEQ ID NO: 586 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methyluridine-3'- phosphorothioate
  modified_base 22: mod_base = OTHER; note = 2'-O-methylguanosine-3'- phosphorothioate
  source 1..23: mol_type = other RNA
aaggaatgttttattgtctctgc

SEQ ID NO: 587 - RNA, 23 nt, synthetic construct
  misc_feature 1..23: note = Synthetic
  source 1..23: mol_type = other RNA
gcagagacaataaaacattcctg

SEQ ID NO: 588 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gagacaataaaacattcctgt

SEQ ID NO: 589 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
acaggaatgttttattgtctctg

SEQ ID NO: 590 - RNA, 23 nt, synthetic construct
  misc_feature 1..23: note = Synthetic
  source 1..23: mol_type = other RNA
cagagacaataaaacattcctgt

SEQ ID NO: 591 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agacaataaaacattcctgtt

SEQ ID NO: 592 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
aacaggaatgttttattgtctct

SEQ ID NO: 593 - RNA, 23 nt, synthetic construct
  misc_feature 1..23: note = Synthetic
  source 1..23: mol_type = other RNA
agagacaataaaacattcctgtg

SEQ ID NO: 594 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gacaataaaacattcctgtga

SEQ ID NO: 595 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 6: mod_base = OTHER; note = 2'-fluoroguanosine-3'-phosphate
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  source 1..23: mol_type = other RNA
tcacaggaatgttttattgtctc

SEQ ID NO: 596 - RNA, 23 nt, synthetic construct
  misc_feature 1..23: note = Synthetic
  source 1..23: mol_type = other RNA
gagacaataaaacattcctgtga

SEQ ID NO: 597 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
acaataaaacattcctgtgaa

SEQ ID NO: 598 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
ttcacaggaatgttttattgtct

SEQ ID NO: 599 - RNA, 23 nt, synthetic construct
  misc_feature 1..23: note = Synthetic
  source 1..23: mol_type = other RNA
agacaataaaacattcctgtgaa

SEQ ID NO: 600 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aataaaacattcctgtgaaat

SEQ ID NO: 601 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluoroadenosine-3'-phosphate
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
atttcacaggaatgttttattgt

SEQ ID NO: 602 - RNA, 23 nt, synthetic construct
  misc_feature 1..23: note = Synthetic
  source 1..23: mol_type = other RNA
acaataaaacattcctgtgaaag

SEQ ID NO: 603 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ataaaacattcctgtgaaagt

SEQ ID NO: 604 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = 2'-fluorocytidine-3'-phosphate
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
actttcacaggaatgttttattg

SEQ ID NO: 605 - RNA, 23 nt, synthetic construct
  misc_feature 1..23: note = Synthetic
  source 1..23: mol_type = other RNA
caataaaacattcctgtgaaagg

SEQ ID NO: 606 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
taaaacattcctgtgaaaggt

SEQ ID NO: 607 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = 2'-fluorouridine-3'-phosphate
  modified_base 14: mod_base = OTHER; note = 2'-fluoroadenosine-3'-phosphate
  modified_base 16: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'- phosphorothioate
  source 1..23: mol_type = other RNA
acctttcacaggaatgttttatt

SEQ ID NO: 608 - RNA, 23 nt, synthetic construct
  misc_feature 1..23: note = Synthetic
  source 1..23: mol_type = other RNA
aataaaacattcctgtgaaaggc

SEQ ID NO: 609 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aaaacattcctgtgaaaggca

SEQ ID NO: 610 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  source 1..23: mol_type = other RNA
tgcctttcacaggaatgttttat

SEQ ID NO: 611 - RNA, 23 nt, synthetic construct
  misc_feature 1..23: note = Synthetic
  source 1..23: mol_type = other RNA
ataaaacattcctgtgaaaggca

SEQ ID NO: 612 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
aaacattcctgtgaaaggcat

SEQ ID NO: 613 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluorouridine-3'-phosphate
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
atgcctttcacaggaatgtttta

SEQ ID NO: 614 - RNA, 23 nt, synthetic construct
  misc_feature 1..23: note = Synthetic
  source 1..23: mol_type = other RNA
taaaacattcctgtgaaaggcac

SEQ ID NO: 615 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluorocytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aacattcctgtgaaaggcact

SEQ ID NO: 616 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluorocytidine-3'-phosphate
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
agtgcctttcacaggaatgtttt

SEQ ID NO: 617 - RNA, 23 nt, synthetic construct
  misc_feature 1..23: note = Synthetic
  source 1..23: mol_type = other RNA
aaaacattcctgtgaaaggcact

SEQ ID NO: 618 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'-phosphorothioate
  modified_base 7: mod_base = OTHER; note = 2'-fluorocytidine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
acattcctgtgaaaggcactt

SEQ ID NO: 619 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 14: mod_base = OTHER; note = 2'-fluoroadenosine-3'-phosphate
  modified_base 16: mod_base = OTHER; note = 2'-fluoroguanosine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
aagtgcctttcacaggaatgttt

SEQ ID NO: 620 - RNA, 23 nt, synthetic construct
  misc_feature 1..23: note = Synthetic
  source 1..23: mol_type = other RNA
aaacattcctgtgaaaggcactt

SEQ ID NO: 621 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
cattcctgtgaaaggcacttt

SEQ ID NO: 622 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
aaagtgcctttcacaggaatgtt

SEQ ID NO: 623 - RNA, 23 nt, synthetic construct
  misc_feature 1..23: note = Synthetic
  source 1..23: mol_type = other RNA
aacattcctgtgaaaggcacttt

SEQ ID NO: 624 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
attcctgtgaaaggcactttt

SEQ ID NO: 625 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorouridine-3'-phosphate
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methyluridine-3'- phosphorothioate
  modified_base 22: mod_base = OTHER; note = 2'-O-methylguanosine-3'- phosphorothioate
  source 1..23: mol_type = other RNA
aaaagtgcctttcacaggaatgt

SEQ ID NO: 626 - RNA, 23 nt, synthetic construct
  misc_feature 1..23: note = Synthetic
  source 1..23: mol_type = other RNA
acattcctgtgaaaggcactttt

SEQ ID NO: 627 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ttcctgtgaaaggcacttttt

SEQ ID NO: 628 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'- phosphorothioate
  source 1..23: mol_type = other RNA
aaaaagtgcctttcacaggaatg

SEQ ID NO: 629 - RNA, 23 nt, synthetic construct
  misc_feature 1..23: note = Synthetic
  source 1..23: mol_type = other RNA
cattcctgtgaaaggcacttttc

SEQ ID NO: 630 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tcctgtgaaaggcacttttca

SEQ ID NO: 631 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  source 1..23: mol_type = other RNA
tgaaaagtgcctttcacaggaat

SEQ ID NO: 632 - RNA, 23 nt, synthetic construct
  misc_feature 1..23: note = Synthetic
  source 1..23: mol_type = other RNA
attcctgtgaaaggcacttttca

SEQ ID NO: 633 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cctgtgaaaggcacttttcat

SEQ ID NO: 634 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note 2'-O-methylguanosinemethyladenosine-3'-phosphorothioate
  modified_base 22: mod_base = OTHER; note = 2'-O-methylguanosine-3'- phosphorothioate
  source 1..23: mol_type = other RNA
atgaaaagtgcctttcacaggaa

SEQ ID NO: 635 - RNA, 23 nt, synthetic construct
  misc_feature 1..23: note = Synthetic
  source 1..23: mol_type = other RNA
ttcctgtgaaaggcacttttcat

SEQ ID NO: 636 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ctgtgaaaggcacttttcatt

SEQ ID NO: 637 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  source 1..23: mol_type = other RNA
aatgaaaagtgcctttcacagga

SEQ ID NO: 638 - RNA, 23 nt, synthetic construct
  misc_feature 1..23: note = Synthetic
  source 1..23: mol_type = other RNA
tcctgtgaaaggcacttttcatt

SEQ ID NO: 639 - RNA, 21 nt, synthetic construct
  misc_feature 1..21: note = Synthetic
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tgtgaaaggcacttttcattt

SEQ ID NO: 640 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  source 1..23: mol_type = other RNA
aaatgaaaagtgcctttcacagg

SEQ ID NO: 641 - RNA, 23 nt, synthetic construct
  misc_feature 1..23: note = Synthetic
  source 1..23: mol_type = other RNA
cctgtgaaaggcacttttcattc

SEQ ID NO: 642 - RNA, 21 nt, synthetic construct
  misc_feature 1..21: note = Synthetic
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
tgaaaggcacttttcattcca

SEQ ID NO: 643 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  source 1..23: mol_type = other RNA
tggaatgaaaagtgcctttcaca

SEQ ID NO: 644 - RNA, 23 nt, synthetic construct
  misc_feature 1..23: note = Synthetic
  source 1..23: mol_type = other RNA
tgtgaaaggcacttttcattcca

SEQ ID NO: 645 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluorocytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gaaaggcacttttcattccat

SEQ ID NO: 646 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  source 1..23: mol_type = other RNA
atggaatgaaaagtgcctttcac

SEQ ID NO: 647 - RNA, 23 nt, synthetic construct
  misc_feature 1..23: note = Synthetic
  source 1..23: mol_type = other RNA
gtgaaaggcacttttcattccac

SEQ ID NO: 648 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluoroguanosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ctgaaggacgagggatgggat

SEQ ID NO: 649 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Thymidine-glycol nucleic acid
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  source 1..23: mol_type = other RNA
atcccatccctcgtccttcaggt

SEQ ID NO: 650 - RNA, 23 nt, synthetic construct
  misc_feature 1..23: note = Synthetic
  source 1..23: mol_type = other RNA
acctgaaggacgagggatgggat

SEQ ID NO: 651 - RNA, 21 nt, synthetic construct
  misc_feature 1..21: note = Synthetic
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tgaaggacgagggatgggatt

SEQ ID NO: 652 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 7: mod_base = OTHER; note = Adenosine-glycol nucleic acid
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  source 1..23: mol_type = other RNA
aatcccatccctcgtccttcagg

SEQ ID NO: 653 - RNA, 23 nt, synthetic construct
  misc_feature 1..23: note = Synthetic
  source 1..23: mol_type = other RNA
cctgaaggacgagggatgggatt

SEQ ID NO: 654 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gaaggacgagggatgggattt

SEQ ID NO: 655 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 7: mod_base = OTHER; note = Cytidine-glycol nucleic acid
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  source 1..23: mol_type = other RNA
aaatcccatccctcgtccttcag

SEQ ID NO: 656 - RNA, 23 nt, synthetic construct
  misc_feature 1..23: note = Synthetic
  source 1..23: mol_type = other RNA
ctgaaggacgagggatgggattt

SEQ ID NO: 657 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
aaggacgagggatgggatttt

SEQ ID NO: 658 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 7: mod_base = OTHER; note = Cytidine-glycol nucleic acid
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
aaaatcccatccctcgtccttca

SEQ ID NO: 659 - RNA, 23 nt, synthetic construct
  misc_feature 1..23: note = Synthetic
  source 1..23: mol_type = other RNA
tgaaggacgagggatgggatttc

SEQ ID NO: 660 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aggacgagggatgggatttca

SEQ ID NO: 661 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 7: mod_base = OTHER; note = Cytidine-glycol nucleic acid
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
tgaaatcccatccctcgtccttc

SEQ ID NO: 662 - RNA, 23 nt, synthetic construct
  misc_feature 1..23: note = Synthetic
  source 1..23: mol_type = other RNA
gaaggacgagggatgggatttca

SEQ ID NO: 663 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ggacgagggatgggatttcat

SEQ ID NO: 664 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Thymidine-glycol nucleic acid
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methylcytidine-3'- phosphorothioate
  modified_base 22: mod_base = OTHER; note = 2'-O-methyluridine-3'- phosphorothioate
  source 1..23: mol_type = other RNA
atgaaatcccatccctcgtcctt

SEQ ID NO: 665 - RNA, 23 nt, synthetic construct
  misc_feature 1..23: note = Synthetic
  source 1..23: mol_type = other RNA
aaggacgagggatgggatttcat

SEQ ID NO: 666 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gacgagggatgggatttcatt

SEQ ID NO: 667 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  source 1..23: mol_type = other RNA
aatgaaatcccatccctcgtcct

SEQ ID NO: 668 - RNA, 23 nt, synthetic construct
  misc_feature 1..23: note = Synthetic
  source 1..23: mol_type = other RNA
aggacgagggatgggatttcatg

SEQ ID NO: 669 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
acgagggatgggatttcatgt

SEQ ID NO: 670 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
acatgaaatcccatccctcgtcc

SEQ ID NO: 671 - RNA, 23 nt, synthetic construct
  misc_feature 1..23: note = Synthetic
  source 1..23: mol_type = other RNA
ggacgagggatgggatttcatgt

SEQ ID NO: 672 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylguanosine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
cgagggatgggatttcatgta

SEQ ID NO: 673 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
tacatgaaatcccatccctcgtc

SEQ ID NO: 674 - RNA, 23 nt, synthetic construct
  misc_feature 1..23: note = Synthetic
  source 1..23: mol_type = other RNA
gacgagggatgggatttcatgta

SEQ ID NO: 675 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gagggatgggatttcatgtaa

SEQ ID NO: 676 - RNA, 23 nt, synthetic construct
  modified_base 6: mod_base = OTHER; note = thymine
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = Thymidine-glycol nucleic acid
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'- phosphorothioate
  source 1..23: mol_type = other RNA
ttacatgaaatcccatccctcgt

SEQ ID NO: 677 - RNA, 23 nt, synthetic construct
  misc_feature 1..23: note = Synthetic
  source 1..23: mol_type = other RNA
acgagggatgggatttcatgtaa

SEQ ID NO: 678 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
agggatgggatttcatgtaat

SEQ ID NO: 679 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Thymidine-glycol nucleic acid
  modified_base 14: mod_base = OTHER; note = 2'-fluorocytidine-3'-phosphate
  modified_base 16: mod_base = OTHER; note = 2'-fluoroadenosine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
attacatgaaatcccatccctcg

SEQ ID NO: 680 - RNA, 23 nt, synthetic construct
  misc_feature 1..23: note = Synthetic
  source 1..23: mol_type = other RNA
cgagggatgggatttcatgtaac

SEQ ID NO: 681 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gggatgggatttcatgtaact

SEQ ID NO: 682 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluorocytidine-3'-phosphate
  modified_base 7: mod_base = OTHER; note = Adenosine-glycol nucleic acid
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'- phosphorothioate
  source 1..23: mol_type = other RNA
agttacatgaaatcccatccctc

SEQ ID NO: 683 - RNA, 23 nt, synthetic construct
  misc_feature 1..23: note = Synthetic
  source 1..23: mol_type = other RNA
gagggatgggatttcatgtaacc

SEQ ID NO: 684 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ggatgggatttcatgtaacca

SEQ ID NO: 685 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 7: mod_base = OTHER; note = Cytidine-glycol nucleic acid
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  source 1..23: mol_type = other RNA
tggttacatgaaatcccatccct

SEQ ID NO: 686 - RNA, 23 nt, synthetic construct
  misc_feature 1..23: note = Synthetic
  source 1..23: mol_type = other RNA
agggatgggatttcatgtaacca

SEQ ID NO: 687 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gatgggatttcatgtaaccaa

SEQ ID NO: 688 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluorouridine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorocytidine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  source 1..23: mol_type = other RNA
ttggttacatgaaatcccatccc

SEQ ID NO: 689 - RNA, 23 nt, synthetic construct
  misc_feature 1..23: note = Synthetic
  source 1..23: mol_type = other RNA
gggatgggatttcatgtaaccaa

SEQ ID NO: 690 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
atgggatttcatgtaaccaat

SEQ ID NO: 691 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluorouridine-3'-phosphate
  modified_base 7: mod_base = OTHER; note = Thymidine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
attggttacatgaaatcccatcc

SEQ ID NO: 692 - RNA, 23 nt, synthetic construct
  misc_feature 1..23: note = Synthetic
  source 1..23: mol_type = other RNA
ggatgggatttcatgtaaccaag

SEQ ID NO: 693 - RNA, 21 nt, synthetic construct
  misc_feature 1..21: note = Synthetic
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
tgggatttcatgtaaccaaga

SEQ ID NO: 694 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorocytidine -3'-phosphorothioate
  modified_base 6: mod_base = OTHER; note = 2'-fluoroguanosine-3'-phosphate
  modified_base 7: mod_base = OTHER; note = Thymidine-glycol nucleic acid
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'- phosphorothioate
  source 1..23: mol_type = other RNA
tcttggttacatgaaatcccatc

SEQ ID NO: 695 - RNA, 23 nt, synthetic construct
  misc_feature 1..23: note = Synthetic
  source 1..23: mol_type = other RNA
gatgggatttcatgtaaccaaga

SEQ ID NO: 696 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gggatttcatgtaaccaagat

SEQ ID NO: 697 - RNA, 23 nt, synthetic construct
  modified_base 8: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroguanosine-3'-phosphate
  modified_base 8: mod_base = OTHER; note = Thymidine-glycol nucleic acid
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  source 1..23: mol_type = other RNA
atcttggttacatgaaatcccat

SEQ ID NO: 698 - RNA, 23 nt, synthetic construct
  misc_feature 1..23: note = Synthetic
  source 1..23: mol_type = other RNA
atgggatttcatgtaaccaagag

SEQ ID NO: 699 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'-phosphorothioate
  modified_base 7: mod_base = OTHER; note = 2'-fluorocytdine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ggatttcatgtaaccaagagt

SEQ ID NO: 700 - RNA, 23 nt, synthetic construct
  modified_base 6: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = Thymidine-glycol nucleic acid
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
actcttggttacatgaaatccca

SEQ ID NO: 701 - RNA, 23 nt, synthetic construct
  misc_feature 1..23: note = Synthetic
  source 1..23: mol_type = other RNA
tgggatttcatgtaaccaagagt

SEQ ID NO: 702 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gatttcatgtaaccaagagta

SEQ ID NO: 703 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroadenosine -3'-phosphorothioate
  modified_base 6: mod_base = OTHER; note = 2'-fluorouridine-3'-phosphate
  modified_base 7: mod_base = OTHER; note = Thymidine-glycol nucleic acid
  modified_base 14: mod_base = OTHER; note = 2'-fluoroadenosine-3'-phosphate
  modified_base 16: mod_base = OTHER; note = 2'-fluoroguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  source 1..23: mol_type = other RNA
tactcttggttacatgaaatccc

SEQ ID NO: 704 - RNA, 23 nt, synthetic construct
  misc_feature 1..23: note = Synthetic
  source 1..23: mol_type = other RNA
gggatttcatgtaaccaagagta

SEQ ID NO: 705 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
atttcatgtaaccaagagtat

SEQ ID NO: 706 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluorocytidine-3'-phosphate
  modified_base 7: mod_base = OTHER; note = Thymidine-glycol nucleic acid
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
atactcttggttacatgaaatcc

SEQ ID NO: 707 - RNA, 23 nt, synthetic construct
  misc_feature 1..23: note = Synthetic
  source 1..23: mol_type = other RNA
ggatttcatgtaaccaagagtat

SEQ ID NO: 708 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tttcatgtaaccaagagtatt

SEQ ID NO: 709 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorouridine-3'-phosphate
  modified_base 7: mod_base = OTHER; note = Cytidine-glycol nucleic acid
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'- phosphorothioate
  source 1..23: mol_type = other RNA
aatactcttggttacatgaaatc

SEQ ID NO: 710 - RNA, 23 nt, synthetic construct
  misc_feature 1..23: note = Synthetic
  source 1..23: mol_type = other RNA
gatttcatgtaaccaagagtatt

SEQ ID NO: 711 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ttcatgtaaccaagagtattt

SEQ ID NO: 712 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 7: mod_base = OTHER; note = Thymidine-glycol nucleic acid
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  source 1..23: mol_type = other RNA
aaatactcttggttacatgaaat

SEQ ID NO: 713 - RNA, 23 nt, synthetic construct
  misc_feature 1..23: note = Synthetic
  source 1..23: mol_type = other RNA
atttcatgtaaccaagagtattc

SEQ ID NO: 714 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'-phosphorothioate
  modified_base 7: mod_base = OTHER; note = 2'-fluoroadenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tcatgtaaccaagagtattct

SEQ ID NO: 715 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 7: mod_base = OTHER; note = Cytidine-glycol nucleic acid
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  source 1..23: mol_type = other RNA
agaatactcttggttacatgaaa

SEQ ID NO: 716 - RNA, 23 nt, synthetic construct
  misc_feature 1..23: note = Synthetic
  source 1..23: mol_type = other RNA
tttcatgtaaccaagagtattcc

SEQ ID NO: 717 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
catgtaaccaagagtattcca

SEQ ID NO: 718 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 7: mod_base = OTHER; note = Adenosine-glycol nucleic acid
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  source 1..23: mol_type = other RNA
tggaatactcttggttacatgaa

SEQ ID NO: 719 - RNA, 23 nt, synthetic construct
  misc_feature 1..23: note = Synthetic
  source 1..23: mol_type = other RNA
ttcatgtaaccaagagtattcca

SEQ ID NO: 720 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
atgtaaccaagagtattccat

SEQ ID NO: 721 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Thymidine-glycol nucleic acid
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methylguanosine-3'- phosphorothioate
  source 1..23: mol_type = other RNA
atggaatactcttggttacatga

SEQ ID NO: 722 - RNA, 23 nt, synthetic construct
  misc_feature 1..23: note = Synthetic
  source 1..23: mol_type = other RNA
tcatgtaaccaagagtattccat

SEQ ID NO: 723 - RNA, 21 nt, synthetic construct
  misc_feature 1..21: note = Synthetic
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluoroguanine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tgtaaccaagagtattccatt

SEQ ID NO: 724 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'- phosphorothioate
  source 1..23: mol_type = other RNA
aatggaatactcttggttacatg

SEQ ID NO: 725 - RNA, 23 nt, synthetic construct
  misc_feature 1..23: note = Synthetic
  source 1..23: mol_type = other RNA
catgtaaccaagagtattccatt

SEQ ID NO: 726 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gtaaccaagagtattccattt

SEQ ID NO: 727 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 7: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  source 1..23: mol_type = other RNA
aaatggaatactcttggttacat

SEQ ID NO: 728 - RNA, 23 nt, synthetic construct
  misc_feature 1..23: note = Synthetic
  source 1..23: mol_type = other RNA
atgtaaccaagagtattccattt

SEQ ID NO: 729 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
taaccaagagtattccatttt

SEQ ID NO: 730 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 7: mod_base = OTHER; note = Adenosine-glycol nucleic acid
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  source 1..23: mol_type = other RNA
aaaatggaatactcttggttaca

SEQ ID NO: 731 - RNA, 23 nt, synthetic construct
  misc_feature 1..23: note = Synthetic
  source 1..23: mol_type = other RNA
tgtaaccaagagtattccatttt

SEQ ID NO: 732 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
accaagagtattccattttta

SEQ ID NO: 733 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroadenosine -3'-phosphorothioate
  modified_base 6: mod_base = OTHER; note = 2'-fluoroadenosine-3'-phosphate
  modified_base 7: mod_base = OTHER; note = Thymidine-glycol nucleic acid
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
taaaaatggaatactcttggtta

SEQ ID NO: 734 - RNA, 23 nt, synthetic construct
  misc_feature 1..23: note = Synthetic
  source 1..23: mol_type = other RNA
taaccaagagtattccattttta

SEQ ID NO: 735 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 736 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 737 - RNA, 23 nt, synthetic construct
  misc_feature 1..23: note = Synthetic
  source 1..23: mol_type = other RNA
aaccaagagtattccatttttac

SEQ ID NO: 738 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 739 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphorothioate
  modified_base 7: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 740 - RNA, 23 nt, synthetic construct
  misc_feature 1..23: note = Synthetic
  source 1..23: mol_type = other RNA
accaagagtattccatttttact

SEQ ID NO: 741 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
aagagtattccatttttacta

SEQ ID NO: 742 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methyluridine-3'- phosphorothioate
  modified_base 22: mod_base = OTHER; note = 2'-O-methylguanosine-3'- phosphorothioate
  source 1..23: mol_type = other RNA
tagtaaaaatggaatactcttgg

SEQ ID NO: 743 - RNA, 23 nt, synthetic construct
  misc_feature 1..23: note = Synthetic
  source 1..23: mol_type = other RNA
ccaagagtattccatttttacta

SEQ ID NO: 744 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactaa

SEQ ID NO: 745 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
ttagtaaaaatggaatactcttg

SEQ ID NO: 746 - RNA, 23 nt, synthetic construct
  misc_feature 1..23: note = Synthetic
  source 1..23: mol_type = other RNA
caagagtattccatttttactaa

SEQ ID NO: 747 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gagtattccatttttactaaa

SEQ ID NO: 748 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluorouridine-3'-phosphate
  modified_base 7: mod_base = OTHER; note = Adenosine-glycol nucleic acid
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'- phosphorothioate
  source 1..23: mol_type = other RNA
tttagtaaaaatggaatactctt

SEQ ID NO: 749 - RNA, 23 nt, synthetic construct
  misc_feature 1..23: note = Synthetic
  source 1..23: mol_type = other RNA
aagagtattccatttttactaaa

SEQ ID NO: 750 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
agtattccatttttactaaat

SEQ ID NO: 751 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroguanosine-3'-phosphate
  modified_base 7: mod_base = OTHER; note = Thymidine-glycol nucleic acid
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
atttagtaaaaatggaatactct

SEQ ID NO: 752 - RNA, 23 nt, synthetic construct
  misc_feature 1..23: note = Synthetic
  source 1..23: mol_type = other RNA
agagtattccatttttactaaag

SEQ ID NO: 753 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gtattccatttttactaaagt

SEQ ID NO: 754 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'- phosphorothioate
  source 1..23: mol_type = other RNA
actttagtaaaaatggaatactc

SEQ ID NO: 755 - RNA, 23 nt, synthetic construct
  misc_feature 1..23: note = Synthetic
  source 1..23: mol_type = other RNA
gagtattccatttttactaaagc

SEQ ID NO: 756 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
tattccatttttactaaagca

SEQ ID NO: 757 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluoroguanosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  source 1..23: mol_type = other RNA
tgctttagtaaaaatggaatact

SEQ ID NO: 758 - RNA, 23 nt, synthetic construct
  misc_feature 1..23: note = Synthetic
  source 1..23: mol_type = other RNA
agtattccatttttactaaagca

SEQ ID NO: 759 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
attccatttttactaaagcat

SEQ ID NO: 760 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluorouridine-3'-phosphate
  modified_base 7: mod_base = OTHER; note = Thymidine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyladenosine-3'- phosphorothioate
  source 1..23: mol_type = other RNA
atgctttagtaaaaatggaatac

SEQ ID NO: 761 - RNA, 23 nt, synthetic construct
  misc_feature 1..23: note = Synthetic
  source 1..23: mol_type = other RNA
gtattccatttttactaaagcag

SEQ ID NO: 762 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ttccatttttactaaagcagt

SEQ ID NO: 763 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorocytidine -3'-phosphorothioate
  modified_base 6: mod_base = OTHER; note = 2'-fluorouridine-3'-phosphate
  modified_base 7: mod_base = OTHER; note = Thymidine-glycol nucleic acid
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'- phosphorothioate
  source 1..23: mol_type = other RNA
actgctttagtaaaaatggaata

SEQ ID NO: 764 - RNA, 23 nt, synthetic construct
  misc_feature 1..23: note = Synthetic
  source 1..23: mol_type = other RNA
tattccatttttactaaagcagt

SEQ ID NO: 765 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tccatttttactaaagcagtt

SEQ ID NO: 766 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 7: mod_base = OTHER; note = Thymidine-glycol nucleic acid
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  source 1..23: mol_type = other RNA
aactgctttagtaaaaatggaat

SEQ ID NO: 767 - RNA, 23 nt, synthetic construct
  misc_feature 1..23: note = Synthetic
  source 1..23: mol_type = other RNA
attccatttttactaaagcagtg

SEQ ID NO: 768 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'-phosphorothioate
  modified_base 7: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccatttttactaaagcagtgt

SEQ ID NO: 769 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = 2'-fluoroguanosine-3'-phosphate
  modified_base 7: mod_base = OTHER; note = Cytidine-glycol nucleic acid
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  source 1..23: mol_type = other RNA
acactgctttagtaaaaatggaa

SEQ ID NO: 770 - RNA, 23 nt, synthetic construct
  misc_feature 1..23: note = Synthetic
  source 1..23: mol_type = other RNA
ttccatttttactaaagcagtgt

SEQ ID NO: 771 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
catttttactaaagcagtgtt

SEQ ID NO: 772 - RNA, 23 nt, synthetic construct
  modified_base 6: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = Thymidine-glycol nucleic acid
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  source 1..23: mol_type = other RNA
aacactgctttagtaaaaatgga

SEQ ID NO: 773 - RNA, 23 nt, synthetic construct
  misc_feature 1..23: note = Synthetic
  source 1..23: mol_type = other RNA
tccatttttactaaagcagtgtt

SEQ ID NO: 774 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
atttttactaaagcagtgttt

SEQ ID NO: 775 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 7: mod_base = OTHER; note = Thymidine-glycol nucleic acid
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'- phosphorothioate
  modified_base 22: mod_base = OTHER; note = 2'-O-methylguanosine-3'- phosphorothioate
  source 1..23: mol_type = other RNA
aaacactgctttagtaaaaatgg

SEQ ID NO: 776 - RNA, 23 nt, synthetic construct
  misc_feature 1..23: note = Synthetic
  source 1..23: mol_type = other RNA
ccatttttactaaagcagtgttt

SEQ ID NO: 777 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tttttactaaagcagtgtttt

SEQ ID NO: 778 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 7: mod_base = OTHER; note = Cytidine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyladenosine-3'- phosphorothioate
  modified_base 22: mod_base = OTHER; note = 2'-O-methyluridine-3'- phosphorothioate
  source 1..23: mol_type = other RNA
aaaacactgctttagtaaaaatg

SEQ ID NO: 779 - RNA, 23 nt, synthetic construct
  misc_feature 1..23: note = Synthetic
  source 1..23: mol_type = other RNA
catttttactaaagcagtgtttt

SEQ ID NO: 780 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ttttactaaagcagtgttttt

SEQ ID NO: 781 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 7: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  source 1..23: mol_type = other RNA
aaaaacactgctttagtaaaaat

SEQ ID NO: 782 - RNA, 23 nt, synthetic construct
  misc_feature 1..23: note = Synthetic
  source 1..23: mol_type = other RNA
atttttactaaagcagtgttttc

SEQ ID NO: 783 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tttactaaagcagtgttttca

SEQ ID NO: 784 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 7: mod_base = OTHER; note = Cytidine-glycol nucleic acid
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  source 1..23: mol_type = other RNA
tgaaaacactgctttagtaaaaa

SEQ ID NO: 785 - RNA, 23 nt, synthetic construct
  misc_feature 1..23: note = Synthetic
  source 1..23: mol_type = other RNA
tttttactaaagcagtgttttca

SEQ ID NO: 786 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ttactaaagcagtgttttcat

SEQ ID NO: 787 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  source 1..23: mol_type = other RNA
atgaaaacactgctttagtaaaa

SEQ ID NO: 788 - RNA, 23 nt, synthetic construct
  misc_feature 1..23: note = Synthetic
  source 1..23: mol_type = other RNA
ttttactaaagcagtgttttcac

SEQ ID NO: 789 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorguanosine-3'-phosphate
  modified_base 21: mod_base = OTHER; note = L96
  source 1..21: mol_type = other RNA
tactaaagcagtgttttcact

SEQ ID NO: 790 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  source 1..23: mol_type = other RNA
agtgaaaacactgctttagtaaa

SEQ ID NO: 791 - RNA, 23 nt, synthetic construct
  misc_feature 1..23: note = Synthetic
  source 1..23: mol_type = other RNA
tttactaaagcagtgttttcacc

SEQ ID NO: 792 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
actaaagcagtgttttcacct

SEQ ID NO: 793 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyladenosine-3'- phosphorothioate
  source 1..23: mol_type = other RNA
aggtgaaaacactgctttagtaa

SEQ ID NO: 794 - RNA, 23 nt, synthetic construct
  misc_feature 1..23: note = Synthetic
  source 1..23: mol_type = other RNA
ttactaaagcagtgttttcacct

SEQ ID NO: 795 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ctaaagcagtgttttcacctt

SEQ ID NO: 796 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 7: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
aaggtgaaaacactgctttagta

SEQ ID NO: 797 - RNA, 23 nt, synthetic construct
  misc_feature 1..23: note = Synthetic
  source 1..23: mol_type = other RNA
tactaaagcagtgttttcacctc

SEQ ID NO: 798 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
taaagcagtgttttcacctca

SEQ ID NO: 799 - RNA, 23 nt, synthetic construct
  modified_base 6: mod_base = OTHER; note = thymine
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroguanosine-3'-phosphorothioate
  modified_base 6: mod_base = OTHER; note = Thymidine-glycol nucleic acid
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  source 1..23: mol_type = other RNA
tgaggtgaaaacactgctttagt

SEQ ID NO: 800 - RNA, 23 nt, synthetic construct
  misc_feature 1..23: note = Synthetic
  source 1..23: mol_type = other RNA
actaaagcagtgttttcacctca

SEQ ID NO: 801 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aaagcagtgttttcacctcat

SEQ ID NO: 802 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroguanosine-3'-phosphate
  modified_base 7: mod_base = OTHER; note = Thymidine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyladenosine-3'- phosphorothioate
  source 1..23: mol_type = other RNA
atgaggtgaaaacactgctttag

SEQ ID NO: 803 - RNA, 23 nt, synthetic construct
  misc_feature 1..23: note = Synthetic
  source 1..23: mol_type = other RNA
ctaaagcagtgttttcacctcat

SEQ ID NO: 804 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aagcagtgttttcacctcata

SEQ ID NO: 805 - RNA, 23 nt, synthetic construct
  modified_base 8: mod_base = OTHER; note = thymine
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroadenosine -3'-phosphorothioate
  modified_base 6: mod_base = OTHER; note = 2'-fluoroguanosine-3'-phosphate
  modified_base 8: mod_base = OTHER; note = Thymidine-glycol nucleic acid
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
tatgaggtgaaaacactgcttta

SEQ ID NO: 806 - RNA, 23 nt, synthetic construct
  misc_feature 1..23: note = Synthetic
  source 1..23: mol_type = other RNA
taaagcagtgttttcacctcata

SEQ ID NO: 807 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
agcagtgttttcacctcatat

SEQ ID NO: 808 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atatgaggtgaaaacactgcttt

SEQ ID NO: 809 - RNA, 23 nt, synthetic construct
  misc_feature 1..23: note = Synthetic
  source 1..23: mol_type = other RNA
aaagcagtgttttcacctcatat

SEQ ID NO: 810 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
agaagtccaggcagagacaat

SEQ ID NO: 811 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluorocytidine-3'-phosphate
  modified_base 7: mod_base = OTHER; note = Thymidine-glycol nucleic acid
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'- phosphorothioate
  modified_base 22: mod_base = OTHER; note = 2'-O-methyladenosine-3'- phosphorothioate
  source 1..23: mol_type = other RNA
attgtctctgcctggacttctaa

SEQ ID NO: 812 - RNA, 23 nt, synthetic construct
  misc_feature 1..23: note = Synthetic
  source 1..23: mol_type = other RNA
ttagaagtccaggcagagacaat

SEQ ID NO: 813 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluorocytidine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gaagtccaggcagagacaata

SEQ ID NO: 814 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluoroadenosine -3'-phosphorothioate
  modified_base 6: mod_base = OTHER; note = 2'-fluorouridine-3'-phosphate
  modified_base 7: mod_base = OTHER; note = Cytidine-glycol nucleic acid
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'- phosphorothioate
  source 1..23: mol_type = other RNA
tattgtctctgcctggacttcta

SEQ ID NO: 815 - RNA, 23 nt, synthetic construct
  misc_feature 1..23: note = Synthetic
  source 1..23: mol_type = other RNA
tagaagtccaggcagagacaata

SEQ ID NO: 816 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aagtccaggcagagacaataa

SEQ ID NO: 817 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluoroguanosine-3'-phosphate
  modified_base 7: mod_base = OTHER; note = Thymidine-glycol nucleic acid
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
ttattgtctctgcctggacttct

SEQ ID NO: 818 - RNA, 23 nt, synthetic construct
  misc_feature 1..23: note = Synthetic
  source 1..23: mol_type = other RNA
agaagtccaggcagagacaataa

SEQ ID NO: 819 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
agtccaggcagagacaataaa

SEQ ID NO: 820 - RNA, 23 nt, synthetic construct
  modified_base 6: mod_base = OTHER; note = thymine
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = Thymidine-glycol nucleic acid
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
tttattgtctctgcctggacttc

SEQ ID NO: 821 - RNA, 23 nt, synthetic construct
  misc_feature 1..23: note = Synthetic
  source 1..23: mol_type = other RNA
gaagtccaggcagagacaataaa

SEQ ID NO: 822 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gtccaggcagagacaataaaa

SEQ ID NO: 823 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluorouridine-3'-phosphate
  modified_base 7: mod_base = OTHER; note = Thymidine-glycol nucleic acid
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
ttttattgtctctgcctggactt

SEQ ID NO: 824 - RNA, 23 nt, synthetic construct
  misc_feature 1..23: note = Synthetic
  source 1..23: mol_type = other RNA
aagtccaggcagagacaataaaa

SEQ ID NO: 825 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'-phosphorothioate
  modified_base 7: mod_base = OTHER; note = 2'-fluorocytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tccaggcagagacaataaaat

SEQ ID NO: 826 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Thymidine-glycol nucleic acid
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  source 1..23: mol_type = other RNA
attttattgtctctgcctggact

SEQ ID NO: 827 - RNA, 23 nt, synthetic construct
  misc_feature 1..23: note = Synthetic
  source 1..23: mol_type = other RNA
agtccaggcagagacaataaaac

SEQ ID NO: 828 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ccaggcagagacaataaaaca

SEQ ID NO: 829 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 7: mod_base = OTHER; note = Adenosine-glycol nucleic acid
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  source 1..23: mol_type = other RNA
tgttttattgtctctgcctggac

SEQ ID NO: 830 - RNA, 23 nt, synthetic construct
  misc_feature 1..23: note = Synthetic
  source 1..23: mol_type = other RNA
gtccaggcagagacaataaaaca

SEQ ID NO: 831 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caggcagagacaataaaacat

SEQ ID NO: 832 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluorouridine-3'-phosphate
  modified_base 7: mod_base = OTHER; note = Thymidine-glycol nucleic acid
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  source 1..23: mol_type = other RNA
atgttttattgtctctgcctgga

SEQ ID NO: 833 - RNA, 23 nt, synthetic construct
  misc_feature 1..23: note = Synthetic
  source 1..23: mol_type = other RNA
tccaggcagagacaataaaacat

SEQ ID NO: 834 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aggcagagacaataaaacatt

SEQ ID NO: 835 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorouridine-3'-phosphate
  modified_base 7: mod_base = OTHER; note = Thymidine-glycol nucleic acid
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methyluridine-3'- phosphorothioate
  modified_base 22: mod_base = OTHER; note = 2'-O-methylguanosine-3'- phosphorothioate
  source 1..23: mol_type = other RNA
aatgttttattgtctctgcctgg

SEQ ID NO: 836 - RNA, 23 nt, synthetic construct
  misc_feature 1..23: note = Synthetic
  source 1..23: mol_type = other RNA
ccaggcagagacaataaaacatt

SEQ ID NO: 837 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ggcagagacaataaaacattt

SEQ ID NO: 838 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorouridine-3'-phosphate
  modified_base 7: mod_base = OTHER; note = Thymidine-glycol nucleic acid
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylcytidine-3'- phosphorothioate
  modified_base 22: mod_base = OTHER; note = 2'-O-methyluridine-3'- phosphorothioate
  source 1..23: mol_type = other RNA
aaatgttttattgtctctgcctg

SEQ ID NO: 839 - RNA, 23 nt, synthetic construct
  misc_feature 1..23: note = Synthetic
  source 1..23: mol_type = other RNA
caggcagagacaataaaacattc

SEQ ID NO: 840 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gcagagacaataaaacattct

SEQ ID NO: 841 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluoroguanosine -3'-phosphorothioate
  modified_base 6: mod_base = OTHER; note = 2'-fluoroguanosine-3'-phosphate
  modified_base 7: mod_base = OTHER; note = Thymidine-glycol nucleic acid
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  source 1..23: mol_type = other RNA
agaatgttttattgtctctgcct

SEQ ID NO: 842 - RNA, 23 nt, synthetic construct
  misc_feature 1..23: note = Synthetic
  source 1..23: mol_type = other RNA
aggcagagacaataaaacattcc

SEQ ID NO: 843 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluoroadenosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagacaataaaacattcctt

SEQ ID NO: 844 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 7: mod_base = OTHER; note = Thymidine-glycol nucleic acid
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methyluridine-3'- phosphorothioate
  modified_base 22: mod_base = OTHER; note = 2'-O-methylguanosine-3'- phosphorothioate
  source 1..23: mol_type = other RNA
aaggaatgttttattgtctctgc

SEQ ID NO: 845 - RNA, 23 nt, synthetic construct
  misc_feature 1..23: note = Synthetic
  source 1..23: mol_type = other RNA
gcagagacaataaaacattcctg

SEQ ID NO: 846 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gagacaataaaacattcctgt

SEQ ID NO: 847 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylcytidine-3'- phosphorothioate
  modified_base 22: mod_base = OTHER; note = 2'-O-methyluridine-3'- phosphorothioate
  source 1..23: mol_type = other RNA
acaggaatgttttattgtctctg

SEQ ID NO: 848 - RNA, 23 nt, synthetic construct
  misc_feature 1..23: note = Synthetic
  source 1..23: mol_type = other RNA
cagagacaataaaacattcctgt

SEQ ID NO: 849 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gacaataaaacattcctgtga

SEQ ID NO: 850 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorocytidine-3'-phosphorothioate
  modified_base 6: mod_base = OTHER; note = 2'-fluoroguanosine-3'-phosphate
  modified_base 7: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'- phosphorothioate
  source 1..23: mol_type = other RNA
tcacaggaatgttttattgtctc

SEQ ID NO: 851 - RNA, 23 nt, synthetic construct
  misc_feature 1..23: note = Synthetic
  source 1..23: mol_type = other RNA
gagacaataaaacattcctgtga

SEQ ID NO: 852 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
acaataaaacattcctgtgaa

SEQ ID NO: 853 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
ttcacaggaatgttttattgtct

SEQ ID NO: 854 - RNA, 23 nt, synthetic construct
  misc_feature 1..23: note = Synthetic
  source 1..23: mol_type = other RNA
agacaataaaacattcctgtgaa

SEQ ID NO: 855 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
caataaaacattcctgtgaaa

SEQ ID NO: 856 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluorocytidine-3'-phosphate
  modified_base 7: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
tttcacaggaatgttttattgtc

SEQ ID NO: 857 - RNA, 23 nt, synthetic construct
  misc_feature 1..23: note = Synthetic
  source 1..23: mol_type = other RNA
gacaataaaacattcctgtgaaa

SEQ ID NO: 858 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aataaaacattcctgtgaaat

SEQ ID NO: 859 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Cytidine-glycol nucleic acid
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methylguanosine-3'- phosphorothioate
  source 1..23: mol_type = other RNA
atttcacaggaatgttttattgt

SEQ ID NO: 860 - RNA, 23 nt, synthetic construct
  misc_feature 1..23: note = Synthetic
  source 1..23: mol_type = other RNA
acaataaaacattcctgtgaaag

SEQ ID NO: 861 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ataaaacattcctgtgaaagt

SEQ ID NO: 862 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 6: mod_base = OTHER; note = 2'-fluorocytidine-3'-phosphate
  modified_base 7: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
actttcacaggaatgttttattg

SEQ ID NO: 863 - RNA, 23 nt, synthetic construct
  misc_feature 1..23: note = Synthetic
  source 1..23: mol_type = other RNA
caataaaacattcctgtgaaagg

SEQ ID NO: 864 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aaaacattcctgtgaaaggca

SEQ ID NO: 865 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 7: mod_base = OTHER; note = Thymidine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyladenosine-3'- phosphorothioate
  source 1..23: mol_type = other RNA
tgcctttcacaggaatgttttat

SEQ ID NO: 866 - RNA, 23 nt, synthetic construct
  misc_feature 1..23: note = Synthetic
  source 1..23: mol_type = other RNA
ataaaacattcctgtgaaaggca

SEQ ID NO: 867 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
aaacattcctgtgaaaggcat

SEQ ID NO: 868 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluorouridine-3'-phosphate
  modified_base 7: mod_base = OTHER; note = Thymidine-glycol nucleic acid
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atgcctttcacaggaatgtttta

SEQ ID NO: 869 - RNA, 23 nt, synthetic construct
  misc_feature 1..23: note = Synthetic
  source 1..23: mol_type = other RNA
taaaacattcctgtgaaaggcac

SEQ ID NO: 870 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluorocytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aacattcctgtgaaaggcact

SEQ ID NO: 871 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluoroguanosine -3'-phosphorothioate
  modified_base 6: mod_base = OTHER; note = 2'-fluorocytidine-3'-phosphate
  modified_base 7: mod_base = OTHER; note = Thymidine-glycol nucleic acid
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
agtgcctttcacaggaatgtttt

SEQ ID NO: 872 - RNA, 23 nt, synthetic construct
  misc_feature 1..23: note = Synthetic
  source 1..23: mol_type = other RNA
aaaacattcctgtgaaaggcact

SEQ ID NO: 873 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'-phosphorothioate
  modified_base 7: mod_base = OTHER; note = 2'-fluorocytidine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
acattcctgtgaaaggcactt

SEQ ID NO: 874 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluorocytidine-3'-phosphate
  modified_base 7: mod_base = OTHER; note = Cytidine-glycol nucleic acid
  modified_base 14: mod_base = OTHER; note = 2'-fluoroadenosine-3'-phosphate
  modified_base 16: mod_base = OTHER; note = 2'-fluoroguanosine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
aagtgcctttcacaggaatgttt

SEQ ID NO: 875 - RNA, 23 nt, synthetic construct
  misc_feature 1..23: note = Synthetic
  source 1..23: mol_type = other RNA
aaacattcctgtgaaaggcactt

SEQ ID NO: 876 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
cattcctgtgaaaggcacttt

SEQ ID NO: 877 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 7: mod_base = OTHER; note = Cytidine-glycol nucleic acid
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
aaagtgcctttcacaggaatgtt

SEQ ID NO: 878 - RNA, 23 nt, synthetic construct
  misc_feature 1..23: note = Synthetic
  source 1..23: mol_type = other RNA
aacattcctgtgaaaggcacttt

SEQ ID NO: 879 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
attcctgtgaaaggcactttt

SEQ ID NO: 880 - RNA, 23 nt, synthetic construct
  modified_base 6: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = Thymidine-glycol nucleic acid
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methyluridine-3'- phosphorothioate
  modified_base 22: mod_base = OTHER; note = 2'-O-methylguanosine-3'- phosphorothioate
  source 1..23: mol_type = other RNA
aaaagtgcctttcacaggaatgt

SEQ ID NO: 881 - RNA, 23 nt, synthetic construct
  misc_feature 1..23: note = Synthetic
  source 1..23: mol_type = other RNA
acattcctgtgaaaggcactttt

SEQ ID NO: 882 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ttcctgtgaaaggcacttttt

SEQ ID NO: 883 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroguanosine-3'-phosphate
  modified_base 7: mod_base = OTHER; note = Thymidine-glycol nucleic acid
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'- phosphorothioate
  source 1..23: mol_type = other RNA
aaaaagtgcctttcacaggaatg

SEQ ID NO: 884 - RNA, 23 nt, synthetic construct
  misc_feature 1..23: note = Synthetic
  source 1..23: mol_type = other RNA
cattcctgtgaaaggcacttttc

SEQ ID NO: 885 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tcctgtgaaaggcacttttca

SEQ ID NO: 886 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroguanosine-3'-phosphorothioate
  modified_base 6: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  source 1..23: mol_type = other RNA
tgaaaagtgcctttcacaggaat

SEQ ID NO: 887 - RNA, 23 nt, synthetic construct
  misc_feature 1..23: note = Synthetic
  source 1..23: mol_type = other RNA
attcctgtgaaaggcacttttca

SEQ ID NO: 888 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'-phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
cctgtgaaaggcacttttcat

SEQ ID NO: 889 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  source 1..23: mol_type = other RNA
atgaaaagtgcctttcacaggaa

SEQ ID NO: 890 - RNA, 23 nt, synthetic construct
  misc_feature 1..23: note = Synthetic
  source 1..23: mol_type = other RNA
ttcctgtgaaaggcacttttcat

SEQ ID NO: 891 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ctgtgaaaggcacttttcatt

SEQ ID NO: 892 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  source 1..23: mol_type = other RNA
aatgaaaagtgcctttcacagga

SEQ ID NO: 893 - RNA, 23 nt, synthetic construct
  misc_feature 1..23: note = Synthetic
  source 1..23: mol_type = other RNA
tcctgtgaaaggcacttttcatt

SEQ ID NO: 894 - RNA, 21 nt, synthetic construct
  misc_feature 1..21: note = Synthetic
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tgtgaaaggcacttttcattt

SEQ ID NO: 895 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  source 1..23: mol_type = other RNA
aaatgaaaagtgcctttcacagg

SEQ ID NO: 896 - RNA, 23 nt, synthetic construct
  misc_feature 1..23: note = Synthetic
  source 1..23: mol_type = other RNA
cctgtgaaaggcacttttcattc

SEQ ID NO: 897 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 7: mod_base = OTHER; note = 2'-fluoroguanosine-3'-phosphate
  modified_base 9: mod_base = OTHER; note = 2'-fluoroacytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gtgaaaggcacttttcattct

SEQ ID NO: 898 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroguanosine-3'-phosphate
  modified_base 7: mod_base = OTHER; note = Adenosine-glycol nucleic acid
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  source 1..23: mol_type = other RNA
agaatgaaaagtgcctttcacag

SEQ ID NO: 899 - RNA, 23 nt, synthetic construct
  misc_feature 1..23: note = Synthetic
  source 1..23: mol_type = other RNA
ctgtgaaaggcacttttcattcc

SEQ ID NO: 900 - RNA, 21 nt, synthetic construct
  misc_feature 1..21: note = Synthetic
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
tgaaaggcacttttcattcca

SEQ ID NO: 901 - RNA, 23 nt, synthetic construct
  modified_base 6: mod_base = OTHER; note = thymine
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroguanosine-3'-phosphorothioate
  modified_base 6: mod_base = OTHER; note = Thymidine-glycol nucleic acid
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  source 1..23: mol_type = other RNA
tggaatgaaaagtgcctttcaca

SEQ ID NO: 902 - RNA, 23 nt, synthetic construct
  misc_feature 1..23: note = Synthetic
  source 1..23: mol_type = other RNA
tgtgaaaggcacttttcattcca

SEQ ID NO: 903 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'-phosphorothioate
  modified_base 7: mod_base = OTHER; note = 2'-fluorocytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gaaaggcacttttcattccat

SEQ ID NO: 904 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Thymidine-glycol nucleic acid
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  source 1..23: mol_type = other RNA
atggaatgaaaagtgcctttcac

SEQ ID NO: 905 - RNA, 23 nt, synthetic construct
  misc_feature 1..23: note = Synthetic
  source 1..23: mol_type = other RNA
gtgaaaggcacttttcattccac

SEQ ID NO: 906 - RNA, 21 nt, synthetic construct
  misc_feature 1..21: note = Synthetic
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluoroguanine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tgtaaccaagagtattccatt

SEQ ID NO: 907 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluoroadenosine -3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'- phosphorothioate
  source 1..23: mol_type = other RNA
aatggaatactcttggttacatg

SEQ ID NO: 908 - RNA, 23 nt, synthetic construct
  misc_feature 1..23: note = Synthetic
  source 1..23: mol_type = other RNA
catgtaaccaagagtattccatt

SEQ ID NO: 909 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aaccaagagtattccattttt

SEQ ID NO: 910 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluoroadenosine -3'-phosphorothioate
  modified_base 6: mod_base = OTHER; note = 2'-fluorouridine-3'-phosphate
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyladenosine-3'- phosphorothioate
  source 1..23: mol_type = other RNA
aaaaatggaatactcttggttac

SEQ ID NO: 911 - RNA, 23 nt, synthetic construct
  misc_feature 1..23: note = Synthetic
  source 1..23: mol_type = other RNA
gtaaccaagagtattccattttt

SEQ ID NO: 912 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
cagagacaataaaacattcct

SEQ ID NO: 913 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluorouridine-3'-phosphate
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
aggaatgttttattgtctctgcc

SEQ ID NO: 914 - RNA, 23 nt, synthetic construct
  misc_feature 1..23: note = Synthetic
  source 1..23: mol_type = other RNA
ggcagagacaataaaacattcct

SEQ ID NO: 915 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tttttactaaagcagtgtttt

SEQ ID NO: 916 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluoroadenosine -3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyladenosine-3'- phosphorothioate
  modified_base 22: mod_base = OTHER; note = 2'-O-methyluridine-3'- phosphorothioate
  source 1..23: mol_type = other RNA
aaaacactgctttagtaaaaatg

SEQ ID NO: 917 - RNA, 23 nt, synthetic construct
  misc_feature 1..23: note = Synthetic
  source 1..23: mol_type = other RNA
catttttactaaagcagtgtttt

SEQ ID NO: 918 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tttcatgtaaccaagagtatt

SEQ ID NO: 919 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluoroadenosine -3'-phosphorothioate
  modified_base 6: mod_base = OTHER; note = 2'-fluorouridine-3'-phosphate
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'- phosphorothioate
  source 1..23: mol_type = other RNA
aatactcttggttacatgaaatc

SEQ ID NO: 920 - RNA, 23 nt, synthetic construct
  misc_feature 1..23: note = Synthetic
  source 1..23: mol_type = other RNA
gatttcatgtaaccaagagtatt

SEQ ID NO: 921 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
caataaaacattcctgtgaaa

SEQ ID NO: 922 - RNA, 23 nt, synthetic construct
  misc_feature 1..23: note = Synthetic
  modified_base 1: mod_base = OTHER; note = 2'-O-methyluridine-3'- phosphorothioate
  modified_base 2: mod_base = OTHER; note = 2'-fluorouridine-3'-phosphorothioate
  modified_base 6: mod_base = OTHER; note = 2'-fluorocytidine-3'-phosphate
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
tttcacaggaatgttttattgtc

SEQ ID NO: 923 - RNA, 23 nt, synthetic construct
  misc_feature 1..23: note = Synthetic
  source 1..23: mol_type = other RNA
gacaataaaacattcctgtgaaa

SEQ ID NO: 924 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aaccaagagtattccattttt

SEQ ID NO: 925 - RNA, 23 nt, synthetic construct
  modified_base 6: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 6: mod_base = OTHER; note = Thymidine-glycol nucleic acid
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyladenosine-3'- phosphorothioate
  source 1..23: mol_type = other RNA
aaaaatggaatactcttggttac

SEQ ID NO: 926 - RNA, 23 nt, synthetic construct
  misc_feature 1..23: note = Synthetic
  source 1..23: mol_type = other RNA
gtaaccaagagtattccattttt

SEQ ID NO: 927 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorocytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
cagagacaataaaacattcct

SEQ ID NO: 928 - RNA, 23 nt, synthetic construct
  modified_base 6: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluoroguanosine -3'-phosphorothioate
  modified_base 6: mod_base = OTHER; note = Thymidine-glycol nucleic acid
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  source 1..23: mol_type = other RNA
aggaatgttttattgtctctgcc

SEQ ID NO: 929 - RNA, 23 nt, synthetic construct
  misc_feature 1..23: note = Synthetic
  source 1..23: mol_type = other RNA
ggcagagacaataaaacattcct

SEQ ID NO: 930 - RNA, 21 nt, synthetic construct
  misc_feature 1..21: note = Synthetic
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
tgggatttcatgtaaccaaga

SEQ ID NO: 931 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 6: mod_base = OTHER; note = 2'-fluoroguanosine-3'-phosphate
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  source 1..23: mol_type = other RNA
tcttggttacatgaaatcccatc

SEQ ID NO: 932 - RNA, 23 nt, synthetic construct
  misc_feature 1..23: note = Synthetic
  source 1..23: mol_type = other RNA
gatgggatttcatgtaaccaaga

SEQ ID NO: 933 - RNA, 21 nt, synthetic construct
  misc_feature 1..21: note = Synthetic
  source 1..21: mol_type = other RNA
ccaagagtattccatttttat

SEQ ID NO: 934 - RNA, 23 nt, synthetic construct
  misc_feature 1..23: note = Synthetic
  source 1..23: mol_type = other RNA
ataaaaatggaatactcttggtt

SEQ ID NO: 935 - RNA, 21 nt, synthetic construct
  misc_feature 1..21: note = Synthetic
  source 1..21: mol_type = other RNA
ccaagagtattccatttttat

SEQ ID NO: 936 - RNA, 23 nt, synthetic construct
  misc_feature 1..23: note = Synthetic
  source 1..23: mol_type = other RNA
ataaaaatggaatactcttggtt

SEQ ID NO: 937 - RNA, 21 nt, synthetic construct
  misc_feature 1..21: note = Synthetic
  source 1..21: mol_type = other RNA
ccaagagtattccatttttat

SEQ ID NO: 938 - RNA, 23 nt, synthetic construct
  misc_feature 1..23: note = Synthetic
  source 1..23: mol_type = other RNA
ataaaaatggaatactcttggtt

SEQ ID NO: 939 - RNA, 21 nt, synthetic construct
  misc_feature 1..21: note = Synthetic
  source 1..21: mol_type = other RNA
ccaagagtattccatttttat

SEQ ID NO: 940 - RNA, 23 nt, synthetic construct
  misc_feature 1..23: note = Synthetic
  source 1..23: mol_type = other RNA
ataaaaatggaatactcttggtt

SEQ ID NO: 941 - RNA, 21 nt, synthetic construct
  misc_feature 1..21: note = Synthetic
  source 1..21: mol_type = other RNA
ccaagagtattccatttttat

SEQ ID NO: 942 - RNA, 23 nt, synthetic construct
  misc_feature 1..23: note = Synthetic
  source 1..23: mol_type = other RNA
ataaaaatggaatactcttggtt

SEQ ID NO: 943 - RNA, 21 nt, synthetic construct
  misc_feature 1..21: note = Synthetic
  source 1..21: mol_type = other RNA
ccaagagtattccatttttat

SEQ ID NO: 944 - RNA, 23 nt, synthetic construct
  misc_feature 1..23: note = Synthetic
  source 1..23: mol_type = other RNA
ataaaaatggaatactcttggtt

SEQ ID NO: 945 - RNA, 21 nt, synthetic construct
  misc_feature 1..21: note = Synthetic
  source 1..21: mol_type = other RNA
ccaagagtattccatttttat

SEQ ID NO: 946 - RNA, 23 nt, synthetic construct
  misc_feature 1..23: note = Synthetic
  source 1..23: mol_type = other RNA
ataaaaatggaatactcttggtt

SEQ ID NO: 947 - RNA, 21 nt, synthetic construct
  misc_feature 1..21: note = Synthetic
  source 1..21: mol_type = other RNA
ccaagagtattccatttttat

SEQ ID NO: 948 - RNA, 23 nt, synthetic construct
  misc_feature 1..23: note = Synthetic
  source 1..23: mol_type = other RNA
ataaaaatggaatactcttggtt

SEQ ID NO: 949 - RNA, 21 nt, synthetic construct
  misc_feature 1..21: note = Synthetic
  source 1..21: mol_type = other RNA
ccaagagtattccatttttat

SEQ ID NO: 950 - RNA, 23 nt, synthetic construct
  misc_feature 1..23: note = Synthetic
  source 1..23: mol_type = other RNA
ataaaaatggaatactcttggtt

SEQ ID NO: 951 - RNA, 21 nt, synthetic construct
  misc_feature 1..21: note = Synthetic
  source 1..21: mol_type = other RNA
ccaagagtattccatttttat

SEQ ID NO: 952 - RNA, 23 nt, synthetic construct
  misc_feature 1..23: note = Synthetic
  source 1..23: mol_type = other RNA
ataaaaatggaatactcttggtt

SEQ ID NO: 953 - RNA, 21 nt, synthetic construct
  misc_feature 1..21: note = Synthetic
  source 1..21: mol_type = other RNA
ccaagagtattccatttttat

SEQ ID NO: 954 - RNA, 23 nt, synthetic construct
  misc_feature 1..23: note = Synthetic
  source 1..23: mol_type = other RNA
ataaaaatggaatactcttggtt

SEQ ID NO: 955 - RNA, 21 nt, synthetic construct
  misc_feature 1..21: note = Synthetic
  source 1..21: mol_type = other RNA
ccaagagtattccatttttat

SEQ ID NO: 956 - RNA, 23 nt, synthetic construct
  misc_feature 1..23: note = Synthetic
  source 1..23: mol_type = other RNA
ataaaaatggaatactcttggtt

SEQ ID NO: 957 - RNA, 21 nt, synthetic construct
  misc_feature 1..21: note = Synthetic
  source 1..21: mol_type = other RNA
ccaagagtattccatttttat

SEQ ID NO: 958 - RNA, 23 nt, synthetic construct
  misc_feature 1..23: note = Synthetic
  source 1..23: mol_type = other RNA
ataaaaatggaatactcttggcc

SEQ ID NO: 959 - RNA, 19 nt, synthetic construct
  misc_feature 1..19: note = Synthetic
  source 1..19: mol_type = other RNA
aagagtattccatttttat

SEQ ID NO: 960 - RNA, 21 nt, synthetic construct
  misc_feature 1..21: note = Synthetic
  source 1..21: mol_type = other RNA
ataaaaatggaatactcttgg

SEQ ID NO: 961 - RNA, 21 nt, synthetic construct
  misc_feature 1..21: note = Synthetic
  source 1..21: mol_type = other RNA
ccaagagtattccatttttat

SEQ ID NO: 962 - RNA, 23 nt, synthetic construct
  misc_feature 1..23: note = Synthetic
  source 1..23: mol_type = other RNA
ataaaaatggaatactcttggcc

SEQ ID NO: 963 - RNA, 19 nt, synthetic construct
  misc_feature 1..19: note = Synthetic
  source 1..19: mol_type = other RNA
aagagtattccatttttat

SEQ ID NO: 964 - RNA, 21 nt, synthetic construct
  misc_feature 1..21: note = Synthetic
  source 1..21: mol_type = other RNA
ataaaaatggaatactcttgg

SEQ ID NO: 965 - RNA, 21 nt, synthetic construct
  misc_feature 1..21: note = Synthetic
  source 1..21: mol_type = other RNA
ccaagagtattccatttttat

SEQ ID NO: 966 - RNA, 23 nt, synthetic construct
  misc_feature 1..23: note = Synthetic
  source 1..23: mol_type = other RNA
ataaaaatggaatactcttggcc

SEQ ID NO: 967 - RNA, 19 nt, synthetic construct
  misc_feature 1..19: note = Synthetic
  source 1..19: mol_type = other RNA
aagagtattccatttttat

SEQ ID NO: 968 - RNA, 21 nt, synthetic construct
  misc_feature 1..21: note = Synthetic
  source 1..21: mol_type = other RNA
ataaaaatggaatactcttgg

SEQ ID NO: 969 - RNA, 21 nt, synthetic construct
  misc_feature 1..21: note = Synthetic
  source 1..21: mol_type = other RNA
ccaagagtattccatttttat

SEQ ID NO: 970 - RNA, 23 nt, synthetic construct
  misc_feature 1..23: note = Synthetic
  source 1..23: mol_type = other RNA
ataaaaatggaatactcttggcc

SEQ ID NO: 971 - RNA, 19 nt, synthetic construct
  misc_feature 1..19: note = Synthetic
  source 1..19: mol_type = other RNA
aagagtattccatttttat

SEQ ID NO: 972 - RNA, 21 nt, synthetic construct
  misc_feature 1..21: note = Synthetic
  source 1..21: mol_type = other RNA
ataaaaatggaatactcttgg

SEQ ID NO: 973 - RNA, 21 nt, synthetic construct
  misc_feature 1..21: note = Synthetic
  source 1..21: mol_type = other RNA
ccaagagtattccatttttat

SEQ ID NO: 974 - RNA, 23 nt, synthetic construct
  misc_feature 1..23: note = Synthetic
  source 1..23: mol_type = other RNA
ataaaaatggaatactcttggcc

SEQ ID NO: 975 - RNA, 19 nt, synthetic construct
  misc_feature 1..19: note = Synthetic
  source 1..19: mol_type = other RNA
aagagtattccatttttat

SEQ ID NO: 976 - RNA, 21 nt, synthetic construct
  misc_feature 1..21: note = Synthetic
  source 1..21: mol_type = other RNA
ataaaaatggaatactcttgg

SEQ ID NO: 977 - RNA, 21 nt, synthetic construct
  misc_feature 1..21: note = Synthetic
  source 1..21: mol_type = other RNA
ccaagagtattccatttttat

SEQ ID NO: 978 - RNA, 23 nt, synthetic construct
  misc_feature 1..23: note = Synthetic
  source 1..23: mol_type = other RNA
ataaaaatggaatactcttggcc

SEQ ID NO: 979 - RNA, 19 nt, synthetic construct
  misc_feature 1..19: note = Synthetic
  source 1..19: mol_type = other RNA
aagagtattccatttttat

SEQ ID NO: 980 - RNA, 21 nt, synthetic construct
  misc_feature 1..21: note = Synthetic
  source 1..21: mol_type = other RNA
ataaaaatggaatactcttgg

SEQ ID NO: 981 - RNA, 21 nt, synthetic construct
  misc_feature 1..21: note = Synthetic
  source 1..21: mol_type = other RNA
ccaagagtattccatttttat

SEQ ID NO: 982 - RNA, 23 nt, synthetic construct
  misc_feature 1..23: note = Synthetic
  source 1..23: mol_type = other RNA
ataaaaatggaatactcttggcc

SEQ ID NO: 983 - RNA, 19 nt, synthetic construct
  misc_feature 1..19: note = Synthetic
  source 1..19: mol_type = other RNA
aagagtattccatttttat

SEQ ID NO: 984 - RNA, 21 nt, synthetic construct
  misc_feature 1..21: note = Synthetic
  source 1..21: mol_type = other RNA
ataaaaatggaatactcttgg

SEQ ID NO: 985 - RNA, 21 nt, synthetic construct
  misc_feature 1..21: note = Synthetic
  source 1..21: mol_type = other RNA
caagagtattccatttttact

SEQ ID NO: 986 - RNA, 23 nt, synthetic construct
  misc_feature 1..23: note = Synthetic
  source 1..23: mol_type = other RNA
agtaaaaatggaatactcttggt

SEQ ID NO: 987 - RNA, 21 nt, synthetic construct
  misc_feature 1..21: note = Synthetic
  source 1..21: mol_type = other RNA
caagagtattccatttttact

SEQ ID NO: 988 - RNA, 23 nt, synthetic construct
  misc_feature 1..23: note = Synthetic
  source 1..23: mol_type = other RNA
agtaaaaatggaatactcttggt

SEQ ID NO: 989 - RNA, 21 nt, synthetic construct
  misc_feature 1..21: note = Synthetic
  source 1..21: mol_type = other RNA
caagagtattccatttttact

SEQ ID NO: 990 - RNA, 23 nt, synthetic construct
  misc_feature 1..23: note = Synthetic
  source 1..23: mol_type = other RNA
agtaaaaatggaatactcttggt

SEQ ID NO: 991 - RNA, 21 nt, synthetic construct
  misc_feature 1..21: note = Synthetic
  source 1..21: mol_type = other RNA
caagagtattccatttttact

SEQ ID NO: 992 - RNA, 23 nt, synthetic construct
  misc_feature 1..23: note = Synthetic
  source 1..23: mol_type = other RNA
agtaaaaatggaatactcttggt

SEQ ID NO: 993 - RNA, 21 nt, synthetic construct
  misc_feature 1..21: note = Synthetic
  source 1..21: mol_type = other RNA
caagagtattccatttttact

SEQ ID NO: 994 - RNA, 23 nt, synthetic construct
  misc_feature 1..23: note = Synthetic
  source 1..23: mol_type = other RNA
agtaaaaatggaatactcttggt

SEQ ID NO: 995 - RNA, 21 nt, synthetic construct
  modified_base 7: mod_base = OTHER; note = thymine
  misc_feature 1..21: note = Synthetic
  source 1..21: mol_type = other RNA
caagagtattccatttttact

SEQ ID NO: 996 - RNA, 23 nt, synthetic construct
  misc_feature 1..23: note = Synthetic
  source 1..23: mol_type = other RNA
agtaaaaatggaatactcttggt

SEQ ID NO: 997 - RNA, 21 nt, synthetic construct
  misc_feature 1..21: note = Synthetic
  source 1..21: mol_type = other RNA
caagagtattccatttttact

SEQ ID NO: 998 - RNA, 23 nt, synthetic construct
  misc_feature 1..23: note = Synthetic
  source 1..23: mol_type = other RNA
agtaaaaatggaatactcttgcc

SEQ ID NO: 999 - RNA, 19 nt, synthetic construct
  misc_feature 1..19: note = Synthetic
  source 1..19: mol_type = other RNA
agagtattccatttttact

SEQ ID NO: 1000 - RNA, 21 nt, synthetic construct
  misc_feature 1..21: note = Synthetic
  source 1..21: mol_type = other RNA
agtaaaaatggaatactcttg

SEQ ID NO: 1001 - RNA, 21 nt, synthetic construct
  misc_feature 1..21: note = Synthetic
  source 1..21: mol_type = other RNA
caagagtattccatttttact

SEQ ID NO: 1002 - RNA, 23 nt, synthetic construct
  modified_base 14: mod_base = OTHER; note = thymine
  misc_feature 1..23: note = Synthetic
  source 1..23: mol_type = other RNA
agtaaaaatggaatactcttggt

SEQ ID NO: 1003 - RNA, 21 nt, synthetic construct
  misc_feature 1..21: note = Synthetic
  source 1..21: mol_type = other RNA
caagagtattccatttttact

SEQ ID NO: 1004 - RNA, 23 nt, synthetic construct
  misc_feature 1..23: note = Synthetic
  source 1..23: mol_type = other RNA
agtaaaaatggaatactcttggt

SEQ ID NO: 1005 - RNA, 21 nt, synthetic construct
  modified_base 7: mod_base = OTHER; note = thymine
  misc_feature 1..21: note = Synthetic
  source 1..21: mol_type = other RNA
caagagtattccatttttact

SEQ ID NO: 1006 - RNA, 23 nt, synthetic construct
  misc_feature 1..23: note = Synthetic
  source 1..23: mol_type = other RNA
agtaaaaatggaatactcttggt

SEQ ID NO: 1007 - RNA, 21 nt, synthetic construct
  misc_feature 1..21: note = Synthetic
  source 1..21: mol_type = other RNA
caagagtattccatttttact

SEQ ID NO: 1008 - RNA, 23 nt, synthetic construct
  misc_feature 1..23: note = Synthetic
  source 1..23: mol_type = other RNA
agtaaaaatggaatactcttggt

SEQ ID NO: 1009 - RNA, 21 nt, synthetic construct
  modified_base 7: mod_base = OTHER; note = thymine
  misc_feature 1..21: note = Synthetic
  source 1..21: mol_type = other RNA
caagagtattccatttttact

SEQ ID NO: 1010 - RNA, 23 nt, synthetic construct
  misc_feature 1..23: note = Synthetic
  source 1..23: mol_type = other RNA
agtaaaaatggaatactcttggt

SEQ ID NO: 1011 - RNA, 21 nt, synthetic construct
  misc_feature 1..21: note = Synthetic
  source 1..21: mol_type = other RNA
caagagtattccatttttact

SEQ ID NO: 1012 - RNA, 23 nt, synthetic construct
  misc_feature 1..23: note = Synthetic
  source 1..23: mol_type = other RNA
agtaaaaatggaatactcttgcc

SEQ ID NO: 1013 - RNA, 19 nt, synthetic construct
  misc_feature 1..19: note = Synthetic
  source 1..19: mol_type = other RNA
agagtattccatttttact

SEQ ID NO: 1014 - RNA, 21 nt, synthetic construct
  misc_feature 1..21: note = Synthetic
  source 1..21: mol_type = other RNA
agtaaaaatggaatactcttg

SEQ ID NO: 1015 - RNA, 21 nt, synthetic construct
  misc_feature 1..21: note = Synthetic
  source 1..21: mol_type = other RNA
caagagtattccatttttact

SEQ ID NO: 1016 - RNA, 23 nt, synthetic construct
  misc_feature 1..23: note = Synthetic
  source 1..23: mol_type = other RNA
agtaaaaatggaatactcttgcc

SEQ ID NO: 1017 - RNA, 19 nt, synthetic construct
  misc_feature 1..19: note = Synthetic
  source 1..19: mol_type = other RNA
agagtattccatttttact

SEQ ID NO: 1018 - RNA, 21 nt, synthetic construct
  misc_feature 1..21: note = Synthetic
  source 1..21: mol_type = other RNA
agtaaaaatggaatactcttg

SEQ ID NO: 1019 - RNA, 21 nt, synthetic construct
  modified_base 7: mod_base = OTHER; note = thymine
  misc_feature 1..21: note = Synthetic
  source 1..21: mol_type = other RNA
caagagtattccatttttact

SEQ ID NO: 1020 - RNA, 23 nt, synthetic construct
  misc_feature 1..23: note = Synthetic
  source 1..23: mol_type = other RNA
agtaaaaatggaatactcttgcc

SEQ ID NO: 1021 - RNA, 19 nt, synthetic construct
  modified_base 5: mod_base = OTHER; note = thymine
  misc_feature 1..19: note = Synthetic
  source 1..19: mol_type = other RNA
agagtattccatttttact

SEQ ID NO: 1022 - RNA, 21 nt, synthetic construct
  misc_feature 1..21: note = Synthetic
  source 1..21: mol_type = other RNA
agtaaaaatggaatactcttg

SEQ ID NO: 1023 - RNA, 21 nt, synthetic construct
  misc_feature 1..21: note = Synthetic
  source 1..21: mol_type = other RNA
caagagtattccatttttact

SEQ ID NO: 1024 - RNA, 23 nt, synthetic construct
  modified_base 14: mod_base = OTHER; note = thymine
  misc_feature 1..23: note = Synthetic
  source 1..23: mol_type = other RNA
agtaaaaatggaatactcttgcc

SEQ ID NO: 1025 - RNA, 19 nt, synthetic construct
  misc_feature 1..19: note = Synthetic
  source 1..19: mol_type = other RNA
agagtattccatttttact

SEQ ID NO: 1026 - RNA, 21 nt, synthetic construct
  modified_base 14: mod_base = OTHER; note = thymine
  misc_feature 1..21: note = Synthetic
  source 1..21: mol_type = other RNA
agtaaaaatggaatactcttg

SEQ ID NO: 1027 - RNA, 21 nt, synthetic construct
  misc_feature 1..21: note = Synthetic
  source 1..21: mol_type = other RNA
agagtattccatttttactaa

SEQ ID NO: 1028 - RNA, 23 nt, synthetic construct
  misc_feature 1..23: note = Synthetic
  source 1..23: mol_type = other RNA
ttagtaaaaatggaatactcttg

SEQ ID NO: 1029 - RNA, 21 nt, synthetic construct
  misc_feature 1..21: note = Synthetic
  source 1..21: mol_type = other RNA
agagtattccatttttactaa

SEQ ID NO: 1030 - RNA, 23 nt, synthetic construct
  misc_feature 1..23: note = Synthetic
  source 1..23: mol_type = other RNA
ttagtaaaaatggaatactcttg

SEQ ID NO: 1031 - RNA, 21 nt, synthetic construct
  misc_feature 1..21: note = Synthetic
  source 1..21: mol_type = other RNA
agagtattccatttttactat

SEQ ID NO: 1032 - RNA, 23 nt, synthetic construct
  misc_feature 1..23: note = Synthetic
  source 1..23: mol_type = other RNA
atagtaaaaatggaatactcttg

SEQ ID NO: 1033 - RNA, 21 nt, synthetic construct
  misc_feature 1..21: note = Synthetic
  source 1..21: mol_type = other RNA
agagtattccatttttactaa

SEQ ID NO: 1034 - RNA, 23 nt, synthetic construct
  modified_base 5: mod_base = OTHER; note = thymine
  misc_feature 1..23: note = Synthetic
  source 1..23: mol_type = other RNA
ttagtaaaaatggaatactcttg

SEQ ID NO: 1035 - RNA, 21 nt, synthetic construct
  misc_feature 1..21: note = Synthetic
  source 1..21: mol_type = other RNA
agagtattccatttttactaa

SEQ ID NO: 1036 - RNA, 23 nt, synthetic construct
  misc_feature 1..23: note = Synthetic
  source 1..23: mol_type = other RNA
ttagtaaaaatggaatactcttg

SEQ ID NO: 1037 - RNA, 21 nt, synthetic construct
  misc_feature 1..21: note = Synthetic
  source 1..21: mol_type = other RNA
agagtattccatttttactaa

SEQ ID NO: 1038 - RNA, 23 nt, synthetic construct
  modified_base 5: mod_base = OTHER; note = thymine
  misc_feature 1..23: note = Synthetic
  source 1..23: mol_type = other RNA
ttagtaaaaatggaatactcttg

SEQ ID NO: 1039 - RNA, 21 nt, synthetic construct
  misc_feature 1..21: note = Synthetic
  source 1..21: mol_type = other RNA
agagtattccatttttactaa

SEQ ID NO: 1040 - RNA, 23 nt, synthetic construct
  misc_feature 1..23: note = Synthetic
  source 1..23: mol_type = other RNA
ttagtaaaaatggaatactcttg

SEQ ID NO: 1041 - RNA, 21 nt, synthetic construct
  misc_feature 1..21: note = Synthetic
  source 1..21: mol_type = other RNA
agagtattccatttttactaa

SEQ ID NO: 1042 - RNA, 23 nt, synthetic construct
  misc_feature 1..23: note = Synthetic
  source 1..23: mol_type = other RNA
ttagtaaaaatggaatactctcc

SEQ ID NO: 1043 - RNA, 19 nt, synthetic construct
  misc_feature 1..19: note = Synthetic
  source 1..19: mol_type = other RNA
agtattccatttttactaa

SEQ ID NO: 1044 - RNA, 21 nt, synthetic construct
  misc_feature 1..21: note = Synthetic
  source 1..21: mol_type = other RNA
ttagtaaaaatggaatactct

SEQ ID NO: 1045 - RNA, 21 nt, synthetic construct
  misc_feature 1..21: note = Synthetic
  source 1..21: mol_type = other RNA
agagtattccatttttactat

SEQ ID NO: 1046 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactcttg

SEQ ID NO: 1047 - RNA, 21 nt, synthetic construct
  misc_feature 1..21: note = Synthetic
  source 1..21: mol_type = other RNA
agagtattccatttttactat

SEQ ID NO: 1048 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactcttg

SEQ ID NO: 1049 - RNA, 21 nt, synthetic construct
  misc_feature 1..21: note = Synthetic
  source 1..21: mol_type = other RNA
agagtattccatttttactat

SEQ ID NO: 1050 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactcttg

SEQ ID NO: 1051 - RNA, 21 nt, synthetic construct
  misc_feature 1..21: note = Synthetic
  source 1..21: mol_type = other RNA
agagtattccatttttactat

SEQ ID NO: 1052 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactcttg

SEQ ID NO: 1053 - RNA, 21 nt, synthetic construct
  misc_feature 1..21: note = Synthetic
  source 1..21: mol_type = other RNA
agagtattccatttttactat

SEQ ID NO: 1054 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactcttg

SEQ ID NO: 1055 - RNA, 21 nt, synthetic construct
  misc_feature 1..21: note = Synthetic
  source 1..21: mol_type = other RNA
agagtattccatttttactat

SEQ ID NO: 1056 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactcttg

SEQ ID NO: 1057 - RNA, 21 nt, synthetic construct
  misc_feature 1..21: note = Synthetic
  source 1..21: mol_type = other RNA
agagtattccatttttactat

SEQ ID NO: 1058 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactcttg

SEQ ID NO: 1059 - RNA, 21 nt, synthetic construct
  misc_feature 1..21: note = Synthetic
  source 1..21: mol_type = other RNA
agagtattccatttttactat

SEQ ID NO: 1060 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactcttg

SEQ ID NO: 1061 - RNA, 21 nt, synthetic construct
  misc_feature 1..21: note = Synthetic
  source 1..21: mol_type = other RNA
agagtattccatttttactat

SEQ ID NO: 1062 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactcttg

SEQ ID NO: 1063 - RNA, 21 nt, synthetic construct
  misc_feature 1..21: note = Synthetic
  source 1..21: mol_type = other RNA
agagtattccatttttactat

SEQ ID NO: 1064 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactcttg

SEQ ID NO: 1065 - RNA, 21 nt, synthetic construct
  misc_feature 1..21: note = Synthetic
  source 1..21: mol_type = other RNA
agagtattccatttttactat

SEQ ID NO: 1066 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactcttg

SEQ ID NO: 1067 - RNA, 21 nt, synthetic construct
  misc_feature 1..21: note = Synthetic
  source 1..21: mol_type = other RNA
agagtattccatttttactat

SEQ ID NO: 1068 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactcttg

SEQ ID NO: 1069 - RNA, 21 nt, synthetic construct
  misc_feature 1..21: note = Synthetic
  source 1..21: mol_type = other RNA
agagtattccatttttactat

SEQ ID NO: 1070 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactctcc

SEQ ID NO: 1071 - RNA, 21 nt, synthetic construct
  misc_feature 1..21: note = Synthetic
  source 1..21: mol_type = other RNA
agagtattccatttttactat

SEQ ID NO: 1072 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactctcc

SEQ ID NO: 1073 - RNA, 21 nt, synthetic construct
  misc_feature 1..21: note = Synthetic
  source 1..21: mol_type = other RNA
agagtattccatttttactat

SEQ ID NO: 1074 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactctcc

SEQ ID NO: 1075 - RNA, 21 nt, synthetic construct
  misc_feature 1..21: note = Synthetic
  source 1..21: mol_type = other RNA
agagtattccatttttactat

SEQ ID NO: 1076 - RNA, 23 nt, synthetic construct
  modified_base 5: mod_base = OTHER; note = thymine
  misc_feature 1..23: note = Synthetic
  source 1..23: mol_type = other RNA
atagtaaaaatggaatactctcc

SEQ ID NO: 1077 - RNA, 19 nt, synthetic construct
  misc_feature 1..19: note = Synthetic
  source 1..19: mol_type = other RNA
agtattccatttttactat

SEQ ID NO: 1078 - RNA, 21 nt, synthetic construct
  modified_base 5: mod_base = OTHER; note = thymine
  misc_feature 1..21: note = Synthetic
  source 1..21: mol_type = other RNA
atagtaaaaatggaatactct

SEQ ID NO: 1079 - RNA, 19 nt, synthetic construct
  misc_feature 1..19: note = Synthetic
  source 1..19: mol_type = other RNA
agtattccatttttactat

SEQ ID NO: 1080 - RNA, 21 nt, synthetic construct
  modified_base 5: mod_base = OTHER; note = thymine
  misc_feature 1..21: note = Synthetic
  source 1..21: mol_type = other RNA
atagtaaaaatggaatactct

SEQ ID NO: 1081 - RNA, 19 nt, synthetic construct
  misc_feature 1..19: note = Synthetic
  source 1..19: mol_type = other RNA
agtattccatttttactat

SEQ ID NO: 1082 - RNA, 21 nt, synthetic construct
  modified_base 5: mod_base = OTHER; note = thymine
  misc_feature 1..21: note = Synthetic
  source 1..21: mol_type = other RNA
atagtaaaaatggaatactct

SEQ ID NO: 1083 - RNA, 19 nt, synthetic construct
  misc_feature 1..19: note = Synthetic
  source 1..19: mol_type = other RNA
agtattccatttttactat

SEQ ID NO: 1084 - RNA, 21 nt, synthetic construct
  modified_base 5: mod_base = OTHER; note = thymine
  misc_feature 1..21: note = Synthetic
  source 1..21: mol_type = other RNA
atagtaaaaatggaatactct

SEQ ID NO: 1085 - RNA, 21 nt, synthetic construct
  misc_feature 1..21: note = Synthetic
  source 1..21: mol_type = other RNA
agagtattccatttttactaa

SEQ ID NO: 1086 - RNA, 23 nt, synthetic construct
  misc_feature 1..23: note = Synthetic
  source 1..23: mol_type = other RNA
ttagtaaaaatggaatactcttg

SEQ ID NO: 1087 - RNA, 21 nt, synthetic construct
  misc_feature 1..21: note = Synthetic
  source 1..21: mol_type = other RNA
ctaaagcagtgttttcaccta

SEQ ID NO: 1088 - RNA, 23 nt, synthetic construct
  modified_base 5: mod_base = OTHER; note = thymine
  misc_feature 1..23: note = Synthetic
  source 1..23: mol_type = other RNA
taggtgaaaacactgctttagta

SEQ ID NO: 1089 - RNA, 21 nt, synthetic construct
  misc_feature 1..21: note = Synthetic
  source 1..21: mol_type = other RNA
ctaaagcagtgttttcaccta

SEQ ID NO: 1090 - RNA, 23 nt, synthetic construct
  modified_base 5: mod_base = OTHER; note = thymine
  misc_feature 1..23: note = Synthetic
  source 1..23: mol_type = other RNA
taggtgaaaacactgctttagta

SEQ ID NO: 1091 - RNA, 21 nt, synthetic construct
  misc_feature 1..21: note = Synthetic
  source 1..21: mol_type = other RNA
ctaaagcagtgttttcaccta

SEQ ID NO: 1092 - RNA, 23 nt, synthetic construct
  modified_base 5: mod_base = OTHER; note = thymine
  misc_feature 1..23: note = Synthetic
  source 1..23: mol_type = other RNA
taggtgaaaacactgctttagta

SEQ ID NO: 1093 - RNA, 21 nt, synthetic construct
  misc_feature 1..21: note = Synthetic
  source 1..21: mol_type = other RNA
ctaaagcagtgttttcacctt

SEQ ID NO: 1094 - RNA, 23 nt, synthetic construct
  modified_base 5: mod_base = OTHER; note = thymine
  misc_feature 1..23: note = Synthetic
  source 1..23: mol_type = other RNA
aaggtgaaaacactgctttagta

SEQ ID NO: 1095 - RNA, 21 nt, synthetic construct
  misc_feature 1..21: note = Synthetic
  source 1..21: mol_type = other RNA
ctaaagcagtgttttcaccta

SEQ ID NO: 1096 - RNA, 23 nt, synthetic construct
  modified_base 5: mod_base = OTHER; note = thymine
  misc_feature 1..23: note = Synthetic
  source 1..23: mol_type = other RNA
taggtgaaaacactgctttagta

SEQ ID NO: 1097 - RNA, 21 nt, synthetic construct
  misc_feature 1..21: note = Synthetic
  source 1..21: mol_type = other RNA
ctaaagcagtgttttcaccta

SEQ ID NO: 1098 - RNA, 23 nt, synthetic construct
  modified_base 5: mod_base = OTHER; note = thymine
  misc_feature 1..23: note = Synthetic
  source 1..23: mol_type = other RNA
taggtgaaaacactgctttagcc

SEQ ID NO: 1099 - RNA, 19 nt, synthetic construct
  misc_feature 1..19: note = Synthetic
  source 1..19: mol_type = other RNA
aaagcagtgttttcaccta

SEQ ID NO: 1100 - RNA, 21 nt, synthetic construct
  modified_base 5: mod_base = OTHER; note = thymine
  misc_feature 1..21: note = Synthetic
  source 1..21: mol_type = other RNA
taggtgaaaacactgctttag

SEQ ID NO: 1101 - RNA, 21 nt, synthetic construct
  misc_feature 1..21: note = Synthetic
  source 1..21: mol_type = other RNA
ctaaagcagtgttttcaccta

SEQ ID NO: 1102 - RNA, 23 nt, synthetic construct
  modified_base 5: mod_base = OTHER; note = thymine
  misc_feature 1..23: note = Synthetic
  source 1..23: mol_type = other RNA
aaggtgaaaacactgctttagta

SEQ ID NO: 1103 - RNA, 21 nt, synthetic construct
  misc_feature 1..21: note = Synthetic
  source 1..21: mol_type = other RNA
ctaaagcagtgttttcaccta

SEQ ID NO: 1104 - RNA, 23 nt, synthetic construct
  modified_base 5: mod_base = OTHER; note = thymine
  misc_feature 1..23: note = Synthetic
  source 1..23: mol_type = other RNA
aaggtgaaaacactgctttagta

SEQ ID NO: 1105 - RNA, 21 nt, synthetic construct
  misc_feature 1..21: note = Synthetic
  source 1..21: mol_type = other RNA
ctaaagcagtgttttcaccta

SEQ ID NO: 1106 - RNA, 23 nt, synthetic construct
  modified_base 5: mod_base = OTHER; note = thymine
  misc_feature 1..23: note = Synthetic
  source 1..23: mol_type = other RNA
aaggtgaaaacactgctttagcc

SEQ ID NO: 1107 - RNA, 21 nt, synthetic construct
  misc_feature 1..21: note = Synthetic
  source 1..21: mol_type = other RNA
ctaaagcagtgttttcaccta

SEQ ID NO: 1108 - RNA, 23 nt, synthetic construct
  modified_base 5: mod_base = OTHER; note = thymine
  misc_feature 1..23: note = Synthetic
  source 1..23: mol_type = other RNA
aaggtgaaaacactgctttagcc

SEQ ID NO: 1109 - RNA, 19 nt, synthetic construct
  misc_feature 1..19: note = Synthetic
  source 1..19: mol_type = other RNA
aaagcagtgttttcaccta

SEQ ID NO: 1110 - RNA, 21 nt, synthetic construct
  modified_base 5: mod_base = OTHER; note = thymine
  misc_feature 1..21: note = Synthetic
  source 1..21: mol_type = other RNA
aaggtgaaaacactgctttag

SEQ ID NO: 1111 - RNA, 19 nt, synthetic construct
  misc_feature 1..19: note = Synthetic
  source 1..19: mol_type = other RNA
aaagcagtgttttcaccta

SEQ ID NO: 1112 - RNA, 21 nt, synthetic construct
  modified_base 5: mod_base = OTHER; note = thymine
  misc_feature 1..21: note = Synthetic
  source 1..21: mol_type = other RNA
aaggtgaaaacactgctttag

SEQ ID NO: 1113 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1114 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 1115 - RNA, 23 nt, synthetic construct
  misc_feature 1..23: note = Synthetic
  source 1..23: mol_type = other RNA
aaccaagagtattccatttttac

SEQ ID NO: 1116 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1117 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 1118 - RNA, 23 nt, synthetic construct
  misc_feature 1..23: note = Synthetic
  source 1..23: mol_type = other RNA
aaccaagagtattccatttttac

SEQ ID NO: 1119 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 7: mod_base = OTHER; note = 2`-deoxyguanosine-3`-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1120 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 1121 - RNA, 23 nt, synthetic construct
  misc_feature 1..23: note = Synthetic
  source 1..23: mol_type = other RNA
aaccaagagtattccatttttac

SEQ ID NO: 1122 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 9: mod_base = OTHER; note = 2`-deoxyadenosine-3`-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1123 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 1124 - RNA, 23 nt, synthetic construct
  misc_feature 1..23: note = Synthetic
  source 1..23: mol_type = other RNA
aaccaagagtattccatttttac

SEQ ID NO: 1125 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 7: mod_base = OTHER; note = 2`-deoxyguanosine-3`-phosphate
  modified_base 9: mod_base = OTHER; note = 2`-deoxyadenosine-3`-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1126 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 1127 - RNA, 23 nt, synthetic construct
  misc_feature 1..23: note = Synthetic
  source 1..23: mol_type = other RNA
aaccaagagtattccatttttac

SEQ ID NO: 1128 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1129 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 1130 - RNA, 23 nt, synthetic construct
  misc_feature 1..23: note = Synthetic
  source 1..23: mol_type = other RNA
aaccaagagtattccatttttac

SEQ ID NO: 1131 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1132 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 1133 - RNA, 23 nt, synthetic construct
  misc_feature 1..23: note = Synthetic
  source 1..23: mol_type = other RNA
aaccaagagtattccatttttac

SEQ ID NO: 1134 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1135 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 1136 - RNA, 23 nt, synthetic construct
  misc_feature 1..23: note = Synthetic
  source 1..23: mol_type = other RNA
aaccaagagtattccatttttac

SEQ ID NO: 1137 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1138 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 1139 - RNA, 23 nt, synthetic construct
  misc_feature 1..23: note = Synthetic
  source 1..23: mol_type = other RNA
aaccaagagtattccatttttac

SEQ ID NO: 1140 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 7: mod_base = OTHER; note = 2`-deoxyguanosine-3`-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1141 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 1142 - RNA, 23 nt, synthetic construct
  misc_feature 1..23: note = Synthetic
  source 1..23: mol_type = other RNA
aaccaagagtattccatttttac

SEQ ID NO: 1143 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1144 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 1145 - RNA, 23 nt, synthetic construct
  misc_feature 1..23: note = Synthetic
  source 1..23: mol_type = other RNA
aaccaagagtattccatttttac

SEQ ID NO: 1146 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 7: mod_base = OTHER; note = 2`-deoxyguanosine-3`-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1147 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
ataaaaatggaatactcttggtt

SEQ ID NO: 1148 - RNA, 23 nt, synthetic construct
  misc_feature 1..23: note = Synthetic
  source 1..23: mol_type = other RNA
aaccaagagtattccatttttac

SEQ ID NO: 1149 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 7: mod_base = OTHER; note = 2'-fluoroguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1150 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  source 1..23: mol_type = other RNA
ataaaaatggaatactcttggcc

SEQ ID NO: 1151 - RNA, 21 nt, synthetic construct
  misc_feature 1..21: note = Synthetic
  source 1..21: mol_type = other RNA
ccaagagtattccatttttac

SEQ ID NO: 1152 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 5: mod_base = OTHER; note = 2'-fluoroguanosine-3'-phosphate
  modified_base 7: mod_base = OTHER; note = 2'-fluoroadenosine-3'-phosphate
  modified_base 8: mod_base = OTHER; note = 2'-fluorouridine-3'-phosphate
  modified_base 9: mod_base = OTHER; note = 2'-fluorouridine-3'-phosphate
  modified_base 19: mod_base = OTHER; note = L96
  source 1..19: mol_type = other RNA
aagagtattccatttttat

SEQ ID NO: 1153 - RNA, 21 nt, synthetic construct
  misc_feature 1..21: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 19: mod_base = OTHER; note = 2'-O-methyluridine-3'- phosphorothioate
  modified_base 20: mod_base = OTHER; note = 2'-O-methylguanosine-3'- phosphorothioate
  source 1..21: mol_type = other RNA
ataaaaatggaatactcttgg

SEQ ID NO: 1154 - RNA, 23 nt, synthetic construct
  misc_feature 1..23: note = Synthetic
  source 1..23: mol_type = other RNA
aaccaagagtattccatttttac

SEQ ID NO: 1155 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1156 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  source 1..23: mol_type = other RNA
ataaaaatggaatactcttggcc

SEQ ID NO: 1157 - RNA, 21 nt, synthetic construct
  misc_feature 1..21: note = Synthetic
  source 1..21: mol_type = other RNA
ccaagagtattccatttttac

SEQ ID NO: 1158 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2'-fluoroadenosine-3'-phosphate
  modified_base 8: mod_base = OTHER; note = 2'-fluorouridine-3'-phosphate
  modified_base 9: mod_base = OTHER; note = 2'-fluorouridine-3'-phosphate
  modified_base 19: mod_base = OTHER; note = L96
  source 1..19: mol_type = other RNA
aagagtattccatttttat

SEQ ID NO: 1159 - RNA, 21 nt, synthetic construct
  misc_feature 1..21: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 19: mod_base = OTHER; note = 2'-O-methyluridine-3'- phosphorothioate
  modified_base 20: mod_base = OTHER; note = 2'-O-methylguanosine-3'- phosphorothioate
  source 1..21: mol_type = other RNA
ataaaaatggaatactcttgg

SEQ ID NO: 1160 - RNA, 23 nt, synthetic construct
  misc_feature 1..23: note = Synthetic
  source 1..23: mol_type = other RNA
aaccaagagtattccatttttac

SEQ ID NO: 1161 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 7: mod_base = OTHER; note = 2`-deoxyguanosine-3`-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1162 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  source 1..23: mol_type = other RNA
ataaaaatggaatactcttggcc

SEQ ID NO: 1163 - RNA, 21 nt, synthetic construct
  misc_feature 1..21: note = Synthetic
  source 1..21: mol_type = other RNA
ccaagagtattccatttttac

SEQ ID NO: 1164 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 5: mod_base = OTHER; note = 2`-deoxyguanosine-3`-phosphate
  modified_base 7: mod_base = OTHER; note = 2'-fluoroadenosine-3'-phosphate
  modified_base 8: mod_base = OTHER; note = 2'-fluorouridine-3'-phosphate
  modified_base 9: mod_base = OTHER; note = 2'-fluorouridine-3'-phosphate
  modified_base 19: mod_base = OTHER; note = L96
  source 1..19: mol_type = other RNA
aagagtattccatttttat

SEQ ID NO: 1165 - RNA, 21 nt, synthetic construct
  misc_feature 1..21: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 19: mod_base = OTHER; note = 2'-O-methyluridine-3'- phosphorothioate
  modified_base 20: mod_base = OTHER; note = 2'-O-methylguanosine-3'- phosphorothioate
  source 1..21: mol_type = other RNA
ataaaaatggaatactcttgg

SEQ ID NO: 1166 - RNA, 23 nt, synthetic construct
  misc_feature 1..23: note = Synthetic
  source 1..23: mol_type = other RNA
aaccaagagtattccatttttac

SEQ ID NO: 1167 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 9: mod_base = OTHER; note = 2`-deoxyadenosine-3`-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1168 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  source 1..23: mol_type = other RNA
ataaaaatggaatactcttggcc

SEQ ID NO: 1169 - RNA, 21 nt, synthetic construct
  misc_feature 1..21: note = Synthetic
  source 1..21: mol_type = other RNA
ccaagagtattccatttttac

SEQ ID NO: 1170 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2`-deoxyadenosine-3`-phosphate
  modified_base 8: mod_base = OTHER; note = 2'-fluorouridine-3'-phosphate
  modified_base 9: mod_base = OTHER; note = 2'-fluorouridine-3'-phosphate
  modified_base 19: mod_base = OTHER; note = L96
  source 1..19: mol_type = other RNA
aagagtattccatttttat

SEQ ID NO: 1171 - RNA, 21 nt, synthetic construct
  misc_feature 1..21: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 19: mod_base = OTHER; note = 2'-O-methyluridine-3'- phosphorothioate
  modified_base 20: mod_base = OTHER; note = 2'-O-methylguanosine-3'- phosphorothioate
  source 1..21: mol_type = other RNA
ataaaaatggaatactcttgg

SEQ ID NO: 1172 - RNA, 23 nt, synthetic construct
  misc_feature 1..23: note = Synthetic
  source 1..23: mol_type = other RNA
aaccaagagtattccatttttac

SEQ ID NO: 1173 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 7: mod_base = OTHER; note = 2`-deoxyguanosine-3`-phosphate
  modified_base 9: mod_base = OTHER; note = 2`-deoxyadenosine-3`-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1174 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  source 1..23: mol_type = other RNA
ataaaaatggaatactcttggcc

SEQ ID NO: 1175 - RNA, 21 nt, synthetic construct
  misc_feature 1..21: note = Synthetic
  source 1..21: mol_type = other RNA
ccaagagtattccatttttac

SEQ ID NO: 1176 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 8: mod_base = OTHER; note = 2'-fluorouridine-3'-phosphate
  modified_base 9: mod_base = OTHER; note = 2'-fluorouridine-3'-phosphate
  modified_base 19: mod_base = OTHER; note = L96
  source 1..19: mol_type = other RNA
aagagtattccatttttat

SEQ ID NO: 1177 - RNA, 21 nt, synthetic construct
  misc_feature 1..21: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 19: mod_base = OTHER; note = 2'-O-methyluridine-3'- phosphorothioate
  modified_base 20: mod_base = OTHER; note = 2'-O-methylguanosine-3'- phosphorothioate
  source 1..21: mol_type = other RNA
ataaaaatggaatactcttgg

SEQ ID NO: 1178 - RNA, 23 nt, synthetic construct
  misc_feature 1..23: note = Synthetic
  source 1..23: mol_type = other RNA
aaccaagagtattccatttttac

SEQ ID NO: 1179 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 9: mod_base = OTHER; note = 2`-deoxyadenosine-3`-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1180 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  source 1..23: mol_type = other RNA
ataaaaatggaatactcttggcc

SEQ ID NO: 1181 - RNA, 21 nt, synthetic construct
  misc_feature 1..21: note = Synthetic
  source 1..21: mol_type = other RNA
ccaagagtattccatttttac

SEQ ID NO: 1182 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 7: mod_base = OTHER; note = 2`-deoxyadenosine-3`-phosphate
  modified_base 8: mod_base = OTHER; note = 2'-fluorouridine-3'-phosphate
  modified_base 9: mod_base = OTHER; note = 2'-fluorouridine-3'-phosphate
  modified_base 19: mod_base = OTHER; note = L96
  source 1..19: mol_type = other RNA
aagagtattccatttttat

SEQ ID NO: 1183 - RNA, 21 nt, synthetic construct
  misc_feature 1..21: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  source 1..21: mol_type = other RNA
ataaaaatggaatactcttgg

SEQ ID NO: 1184 - RNA, 23 nt, synthetic construct
  misc_feature 1..23: note = Synthetic
  source 1..23: mol_type = other RNA
aaccaagagtattccatttttac

SEQ ID NO: 1185 - RNA, 21 nt, synthetic construct
  misc_feature 1..21: note = Synthetic
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 7: mod_base = OTHER; note = 2`-deoxyguanosine-3`-phosphate
  modified_base 9: mod_base = OTHER; note = 2`-deoxyadenosine-3`-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ccaagagtattccatttttat

SEQ ID NO: 1186 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  source 1..23: mol_type = other RNA
ataaaaatggaatactcttggcc

SEQ ID NO: 1187 - RNA, 21 nt, synthetic construct
  misc_feature 1..21: note = Synthetic
  source 1..21: mol_type = other RNA
ccaagagtattccatttttac

SEQ ID NO: 1188 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 8: mod_base = OTHER; note = 2'-fluorouridine-3'-phosphate
  modified_base 9: mod_base = OTHER; note = 2'-fluorouridine-3'-phosphate
  modified_base 19: mod_base = OTHER; note = L96
  source 1..19: mol_type = other RNA
aagagtattccatttttat

SEQ ID NO: 1189 - RNA, 21 nt, synthetic construct
  misc_feature 1..21: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2`-deoxyadenosine-3`-phosphate
  modified_base 16: mod_base = OTHER; note = 2'-fluorouridine-3'-phosphate
  modified_base 19: mod_base = OTHER; note = 2'-O-methyluridine-3'- phosphorothioate
  modified_base 20: mod_base = OTHER; note = 2'-O-methylguanosine-3'- phosphorothioate
  source 1..21: mol_type = other RNA
ataaaaatggaatactcttgg

SEQ ID NO: 1190 - RNA, 23 nt, synthetic construct
  misc_feature 1..23: note = Synthetic
  source 1..23: mol_type = other RNA
aaccaagagtattccatttttac

SEQ ID NO: 1191 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1192 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 1193 - RNA, 23 nt, synthetic construct
  misc_feature 1..23: note = Synthetic
  source 1..23: mol_type = other RNA
accaagagtattccatttttact

SEQ ID NO: 1194 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1195 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 1196 - RNA, 23 nt, synthetic construct
  misc_feature 1..23: note = Synthetic
  source 1..23: mol_type = other RNA
accaagagtattccatttttact

SEQ ID NO: 1197 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1198 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 1199 - RNA, 23 nt, synthetic construct
  misc_feature 1..23: note = Synthetic
  source 1..23: mol_type = other RNA
accaagagtattccatttttact

SEQ ID NO: 1200 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1201 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 1202 - RNA, 23 nt, synthetic construct
  misc_feature 1..23: note = Synthetic
  source 1..23: mol_type = other RNA
accaagagtattccatttttact

SEQ ID NO: 1203 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1204 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 1205 - RNA, 23 nt, synthetic construct
  misc_feature 1..23: note = Synthetic
  source 1..23: mol_type = other RNA
accaagagtattccatttttact

SEQ ID NO: 1206 - RNA, 21 nt, synthetic construct
  modified_base 7: mod_base = OTHER; note = thymine
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2`-deoxythimidine -3`-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1207 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 1208 - RNA, 23 nt, synthetic construct
  misc_feature 1..23: note = Synthetic
  source 1..23: mol_type = other RNA
accaagagtattccatttttact

SEQ ID NO: 1209 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1210 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agtaaaaatggaatactcttgcc

SEQ ID NO: 1211 - RNA, 23 nt, synthetic construct
  misc_feature 1..23: note = Synthetic
  source 1..23: mol_type = other RNA
accaagagtattccatttttact

SEQ ID NO: 1212 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 5: mod_base = OTHER; note = 2'-fluorouridine-3'-phosphate
  modified_base 7: mod_base = OTHER; note = 2'-fluorouridine-3'-phosphate
  modified_base 8: mod_base = OTHER; note = 2'-fluorouridine-3'-phosphate
  modified_base 9: mod_base = OTHER; note = 2'-fluorocytidine-3'-phosphate
  modified_base 19: mod_base = OTHER; note = L96
  source 1..19: mol_type = other RNA
agagtattccatttttact

SEQ ID NO: 1213 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19: mod_base = OTHER; note = 2'-O-methyluridine-3'-phosphorothioate
  modified_base 20: mod_base = OTHER; note = 2'-O-methyluridine-3'- phosphorothioate
  source 1..21: mol_type = other RNA
agtaaaaatggaatactcttg

SEQ ID NO: 1214 - RNA, 21 nt, synthetic construct
  misc_feature 1..21: note = Synthetic
  source 1..21: mol_type = other RNA
caagagtattccatttttact

SEQ ID NO: 1215 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1216 - RNA, 23 nt, synthetic construct
  modified_base 14: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxyadenosine-3`-phosphate
  modified_base 14: mod_base = OTHER; note = 2`-deoxythimidine -3`-phosphate
  modified_base 16: mod_base = OTHER; note = 2`-deoxycytidine-3`-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 1217 - RNA, 23 nt, synthetic construct
  misc_feature 1..23: note = Synthetic
  source 1..23: mol_type = other RNA
accaagagtattccatttttact

SEQ ID NO: 1218 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1219 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 1220 - RNA, 23 nt, synthetic construct
  misc_feature 1..23: note = Synthetic
  source 1..23: mol_type = other RNA
accaagagtattccatttttact

SEQ ID NO: 1221 - RNA, 21 nt, synthetic construct
  modified_base 7: mod_base = OTHER; note = thymine
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2`-deoxythimidine -3`-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1222 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 6: mod_base = OTHER; note = 2'-fluoroadenosine-3'-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 1223 - RNA, 23 nt, synthetic construct
  misc_feature 1..23: note = Synthetic
  source 1..23: mol_type = other RNA
accaagagtattccatttttact

SEQ ID NO: 1224 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1225 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 1226 - RNA, 23 nt, synthetic construct
  misc_feature 1..23: note = Synthetic
  source 1..23: mol_type = other RNA
accaagagtattccatttttact

SEQ ID NO: 1227 - RNA, 21 nt, synthetic construct
  modified_base 7: mod_base = OTHER; note = thymine
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2`-deoxythimidine -3`-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1228 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agtaaaaatggaatactcttggt

SEQ ID NO: 1229 - RNA, 23 nt, synthetic construct
  misc_feature 1..23: note = Synthetic
  source 1..23: mol_type = other RNA
accaagagtattccatttttact

SEQ ID NO: 1230 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1231 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agtaaaaatggaatactcttgcc

SEQ ID NO: 1232 - RNA, 23 nt, synthetic construct
  misc_feature 1..23: note = Synthetic
  source 1..23: mol_type = other RNA
accaagagtattccatttttact

SEQ ID NO: 1233 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 5: mod_base = OTHER; note = 2'-fluorouridine-3'-phosphate
  modified_base 7: mod_base = OTHER; note = 2'-fluorouridine-3'-phosphate
  modified_base 8: mod_base = OTHER; note = 2'-fluorouridine-3'-phosphate
  modified_base 9: mod_base = OTHER; note = 2'-fluorocytidine-3'-phosphate
  modified_base 19: mod_base = OTHER; note = L96
  source 1..19: mol_type = other RNA
agagtattccatttttact

SEQ ID NO: 1234 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19: mod_base = OTHER; note = 2'-O-methyluridine-3'-phosphorothioate
  modified_base 20: mod_base = OTHER; note = 2'-O-methyluridine-3'- phosphorothioate
  source 1..21: mol_type = other RNA
agtaaaaatggaatactcttg

SEQ ID NO: 1235 - RNA, 21 nt, synthetic construct
  misc_feature 1..21: note = Synthetic
  source 1..21: mol_type = other RNA
caagagtattccatttttact

SEQ ID NO: 1236 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1237 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agtaaaaatggaatactcttgcc

SEQ ID NO: 1238 - RNA, 23 nt, synthetic construct
  misc_feature 1..23: note = Synthetic
  source 1..23: mol_type = other RNA
accaagagtattccatttttact

SEQ ID NO: 1239 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 8: mod_base = OTHER; note = 2'-fluorouridine-3'-phosphate
  modified_base 9: mod_base = OTHER; note = 2'-fluorocytidine-3'-phosphate
  modified_base 19: mod_base = OTHER; note = L96
  source 1..19: mol_type = other RNA
agagtattccatttttact

SEQ ID NO: 1240 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19: mod_base = OTHER; note = 2'-O-methyluridine-3'-phosphorothioate
  modified_base 20: mod_base = OTHER; note = 2'-O-methyluridine-3'- phosphorothioate
  source 1..21: mol_type = other RNA
agtaaaaatggaatactcttg

SEQ ID NO: 1241 - RNA, 21 nt, synthetic construct
  misc_feature 1..21: note = Synthetic
  source 1..21: mol_type = other RNA
caagagtattccatttttact

SEQ ID NO: 1242 - RNA, 21 nt, synthetic construct
  modified_base 7: mod_base = OTHER; note = thymine
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 7: mod_base = OTHER; note = 2`-deoxythimidine -3`-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1243 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agtaaaaatggaatactcttgcc

SEQ ID NO: 1244 - RNA, 23 nt, synthetic construct
  misc_feature 1..23: note = Synthetic
  source 1..23: mol_type = other RNA
accaagagtattccatttttact

SEQ ID NO: 1245 - RNA, 19 nt, synthetic construct
  modified_base 5: mod_base = OTHER; note = thymine
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 5: mod_base = OTHER; note = 2`-deoxythimidine -3`-phosphate
  modified_base 7: mod_base = OTHER; note = 2'-fluorouridine-3'-phosphate
  modified_base 8: mod_base = OTHER; note = 2'-fluorouridine-3'-phosphate
  modified_base 9: mod_base = OTHER; note = 2'-fluorocytidine-3'-phosphate
  modified_base 19: mod_base = OTHER; note = L96
  source 1..19: mol_type = other RNA
agagtattccatttttact

SEQ ID NO: 1246 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19: mod_base = OTHER; note = 2'-O-methyluridine-3'-phosphorothioate
  modified_base 20: mod_base = OTHER; note = 2'-O-methyluridine-3'- phosphorothioate
  source 1..21: mol_type = other RNA
agtaaaaatggaatactcttg

SEQ ID NO: 1247 - RNA, 21 nt, synthetic construct
  misc_feature 1..21: note = Synthetic
  source 1..21: mol_type = other RNA
caagagtattccatttttact

SEQ ID NO: 1248 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'-phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caagagtattccatttttact

SEQ ID NO: 1249 - RNA, 23 nt, synthetic construct
  modified_base 14: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxyadenosine-3`-phosphate
  modified_base 14: mod_base = OTHER; note = 2`-deoxythimidine -3`-phosphate
  modified_base 16: mod_base = OTHER; note = 2`-deoxycytidine-3`-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agtaaaaatggaatactcttgcc

SEQ ID NO: 1250 - RNA, 23 nt, synthetic construct
  misc_feature 1..23: note = Synthetic
  source 1..23: mol_type = other RNA
accaagagtattccatttttact

SEQ ID NO: 1251 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 8: mod_base = OTHER; note = 2'-fluorouridine-3'-phosphate
  modified_base 9: mod_base = OTHER; note = 2'-fluorocytidine-3'-phosphate
  modified_base 19: mod_base = OTHER; note = L96
  source 1..19: mol_type = other RNA
agagtattccatttttact

SEQ ID NO: 1252 - RNA, 21 nt, synthetic construct
  modified_base 14: mod_base = OTHER; note = thymine
  misc_feature 1..21: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxyadenosine-3`-phosphate
  modified_base 14: mod_base = OTHER; note = 2`-deoxythimidine -3`-phosphate
  modified_base 16: mod_base = OTHER; note = 2`-deoxycytidine-3`-phosphate
  modified_base 19: mod_base = OTHER; note = 2'-O-methyluridine-3'-phosphorothioate
  modified_base 20: mod_base = OTHER; note = 2'-O-methyluridine-3'- phosphorothioate
  source 1..21: mol_type = other RNA
agtaaaaatggaatactcttg

SEQ ID NO: 1253 - RNA, 21 nt, synthetic construct
  misc_feature 1..21: note = Synthetic
  source 1..21: mol_type = other RNA
caagagtattccatttttact

SEQ ID NO: 1254 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactaa

SEQ ID NO: 1255 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
ttagtaaaaatggaatactcttg

SEQ ID NO: 1256 - RNA, 23 nt, synthetic construct
  misc_feature 1..23: note = Synthetic
  source 1..23: mol_type = other RNA
caagagtattccatttttactaa

SEQ ID NO: 1257 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2`-deoxyadenosine-3`-phosphate
  modified_base 12: mod_base = OTHER; note = 2'-fluorouridine-3'-phosphate
  modified_base 21: mod_base = OTHER; note = L96
  source 1..21: mol_type = other RNA
agagtattccatttttactaa

SEQ ID NO: 1258 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
ttagtaaaaatggaatactcttg

SEQ ID NO: 1259 - RNA, 23 nt, synthetic construct
  misc_feature 1..23: note = Synthetic
  source 1..23: mol_type = other RNA
caagagtattccatttttactaa

SEQ ID NO: 1260 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 11: mod_base = OTHER; note = 2`-deoxyadenosine-3`-phosphate
  modified_base 12: mod_base = OTHER; note = 2'-fluorouridine-3'-phosphate
  modified_base 21: mod_base = OTHER; note = L96
  source 1..21: mol_type = other RNA
agagtattccatttttactaa

SEQ ID NO: 1261 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
ttagtaaaaatggaatactcttg

SEQ ID NO: 1262 - RNA, 23 nt, synthetic construct
  misc_feature 1..23: note = Synthetic
  source 1..23: mol_type = other RNA
caagagtattccatttttactaa

SEQ ID NO: 1263 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactat

SEQ ID NO: 1264 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1265 - RNA, 23 nt, synthetic construct
  misc_feature 1..23: note = Synthetic
  source 1..23: mol_type = other RNA
caagagtattccatttttactaa

SEQ ID NO: 1266 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactaa

SEQ ID NO: 1267 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
ttagtaaaaatggaatactcttg

SEQ ID NO: 1268 - RNA, 23 nt, synthetic construct
  misc_feature 1..23: note = Synthetic
  source 1..23: mol_type = other RNA
caagagtattccatttttactaa

SEQ ID NO: 1269 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactaa

SEQ ID NO: 1270 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
ttagtaaaaatggaatactcttg

SEQ ID NO: 1271 - RNA, 23 nt, synthetic construct
  misc_feature 1..23: note = Synthetic
  source 1..23: mol_type = other RNA
caagagtattccatttttactaa

SEQ ID NO: 1272 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactaa

SEQ ID NO: 1273 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
ttagtaaaaatggaatactcttg

SEQ ID NO: 1274 - RNA, 23 nt, synthetic construct
  misc_feature 1..23: note = Synthetic
  source 1..23: mol_type = other RNA
caagagtattccatttttactaa

SEQ ID NO: 1275 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactaa

SEQ ID NO: 1276 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
ttagtaaaaatggaatactcttg

SEQ ID NO: 1277 - RNA, 23 nt, synthetic construct
  misc_feature 1..23: note = Synthetic
  source 1..23: mol_type = other RNA
caagagtattccatttttactaa

SEQ ID NO: 1278 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactaa

SEQ ID NO: 1279 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
ttagtaaaaatggaatactctcc

SEQ ID NO: 1280 - RNA, 23 nt, synthetic construct
  misc_feature 1..23: note = Synthetic
  source 1..23: mol_type = other RNA
caagagtattccatttttactaa

SEQ ID NO: 1281 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 5: mod_base = OTHER; note = 2'-fluorouridine-3'-phosphate
  modified_base 7: mod_base = OTHER; note = 2'-fluorocytidine-3'-phosphate
  modified_base 8: mod_base = OTHER; note = 2'-fluorocytidine-3'-phosphate
  modified_base 9: mod_base = OTHER; note = 2'-fluoroadenosine-3'-phosphate
  modified_base 19: mod_base = OTHER; note = L96
  source 1..19: mol_type = other RNA
agtattccatttttactaa

SEQ ID NO: 1282 - RNA, 21 nt, synthetic construct
  misc_feature 1..21: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 19: mod_base = OTHER; note = 2'-O-methyluridine-3'- phosphorothioate
  modified_base 20: mod_base = OTHER; note = 2'-O-methylcytidine-3'- phosphorothioate
  source 1..21: mol_type = other RNA
ttagtaaaaatggaatactct

SEQ ID NO: 1283 - RNA, 21 nt, synthetic construct
  misc_feature 1..21: note = Synthetic
  source 1..21: mol_type = other RNA
agagtattccatttttactaa

SEQ ID NO: 1284 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactat

SEQ ID NO: 1285 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1286 - RNA, 23 nt, synthetic construct
  misc_feature 1..23: note = Synthetic
  source 1..23: mol_type = other RNA
caagagtattccatttttactaa

SEQ ID NO: 1287 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactat

SEQ ID NO: 1288 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1289 - RNA, 23 nt, synthetic construct
  misc_feature 1..23: note = Synthetic
  source 1..23: mol_type = other RNA
caagagtattccatttttactaa

SEQ ID NO: 1290 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactat

SEQ ID NO: 1291 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1292 - RNA, 23 nt, synthetic construct
  misc_feature 1..23: note = Synthetic
  source 1..23: mol_type = other RNA
caagagtattccatttttactaa

SEQ ID NO: 1293 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agagtattccatttttactat

SEQ ID NO: 1294 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1295 - RNA, 23 nt, synthetic construct
  misc_feature 1..23: note = Synthetic
  source 1..23: mol_type = other RNA
caagagtattccatttttactaa

SEQ ID NO: 1296 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2`-deoxyadenosine-3`-phosphate
  modified_base 21: mod_base = OTHER; note = L96
  source 1..21: mol_type = other RNA
agagtattccatttttactat

SEQ ID NO: 1297 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1298 - RNA, 23 nt, synthetic construct
  misc_feature 1..23: note = Synthetic
  source 1..23: mol_type = other RNA
caagagtattccatttttactaa

SEQ ID NO: 1299 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2`-deoxyadenosine-3`-phosphate
  modified_base 21: mod_base = OTHER; note = L96
  source 1..21: mol_type = other RNA
agagtattccatttttactat

SEQ ID NO: 1300 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1301 - RNA, 23 nt, synthetic construct
  misc_feature 1..23: note = Synthetic
  source 1..23: mol_type = other RNA
caagagtattccatttttactaa

SEQ ID NO: 1302 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2`-deoxyadenosine-3`-phosphate
  modified_base 21: mod_base = OTHER; note = L96
  source 1..21: mol_type = other RNA
agagtattccatttttactat

SEQ ID NO: 1303 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1304 - RNA, 23 nt, synthetic construct
  misc_feature 1..23: note = Synthetic
  source 1..23: mol_type = other RNA
caagagtattccatttttactaa

SEQ ID NO: 1305 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2`-deoxyadenosine-3`-phosphate
  modified_base 21: mod_base = OTHER; note = L96
  source 1..21: mol_type = other RNA
agagtattccatttttactat

SEQ ID NO: 1306 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1307 - RNA, 23 nt, synthetic construct
  misc_feature 1..23: note = Synthetic
  source 1..23: mol_type = other RNA
caagagtattccatttttactaa

SEQ ID NO: 1308 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 11: mod_base = OTHER; note = 2`-deoxyadenosine-3`-phosphate
  modified_base 12: mod_base = OTHER; note = 2'-fluorouridine-3'-phosphate
  modified_base 21: mod_base = OTHER; note = L96
  source 1..21: mol_type = other RNA
agagtattccatttttactat

SEQ ID NO: 1309 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1310 - RNA, 23 nt, synthetic construct
  misc_feature 1..23: note = Synthetic
  source 1..23: mol_type = other RNA
caagagtattccatttttactaa

SEQ ID NO: 1311 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 11: mod_base = OTHER; note = 2`-deoxyadenosine-3`-phosphate
  modified_base 12: mod_base = OTHER; note = 2'-fluorouridine-3'-phosphate
  modified_base 21: mod_base = OTHER; note = L96
  source 1..21: mol_type = other RNA
agagtattccatttttactat

SEQ ID NO: 1312 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1313 - RNA, 23 nt, synthetic construct
  misc_feature 1..23: note = Synthetic
  source 1..23: mol_type = other RNA
caagagtattccatttttactaa

SEQ ID NO: 1314 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 11: mod_base = OTHER; note = 2`-deoxyadenosine-3`-phosphate
  modified_base 12: mod_base = OTHER; note = 2'-fluorouridine-3'-phosphate
  modified_base 21: mod_base = OTHER; note = L96
  source 1..21: mol_type = other RNA
agagtattccatttttactat

SEQ ID NO: 1315 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1316 - RNA, 23 nt, synthetic construct
  misc_feature 1..23: note = Synthetic
  source 1..23: mol_type = other RNA
caagagtattccatttttactaa

SEQ ID NO: 1317 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 11: mod_base = OTHER; note = 2`-deoxyadenosine-3`-phosphate
  modified_base 12: mod_base = OTHER; note = 2'-fluorouridine-3'-phosphate
  modified_base 21: mod_base = OTHER; note = L96
  source 1..21: mol_type = other RNA
agagtattccatttttactat

SEQ ID NO: 1318 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methyluridine-3'- phosphorothioate
  source 1..23: mol_type = other RNA
atagtaaaaatggaatactcttg

SEQ ID NO: 1319 - RNA, 23 nt, synthetic construct
  misc_feature 1..23: note = Synthetic
  source 1..23: mol_type = other RNA
caagagtattccatttttactaa

SEQ ID NO: 1320 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2`-deoxyadenosine-3`-phosphate
  modified_base 21: mod_base = OTHER; note = L96
  source 1..21: mol_type = other RNA
agagtattccatttttactat

SEQ ID NO: 1321 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
atagtaaaaatggaatactctcc

SEQ ID NO: 1322 - RNA, 23 nt, synthetic construct
  misc_feature 1..23: note = Synthetic
  source 1..23: mol_type = other RNA
caagagtattccatttttactaa

SEQ ID NO: 1323 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2`-deoxyadenosine-3`-phosphate
  modified_base 21: mod_base = OTHER; note = L96
  source 1..21: mol_type = other RNA
agagtattccatttttactat

SEQ ID NO: 1324 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
atagtaaaaatggaatactctcc

SEQ ID NO: 1325 - RNA, 23 nt, synthetic construct
  misc_feature 1..23: note = Synthetic
  source 1..23: mol_type = other RNA
caagagtattccatttttactaa

SEQ ID NO: 1326 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2`-deoxyadenosine-3`-phosphate
  modified_base 21: mod_base = OTHER; note = L96
  source 1..21: mol_type = other RNA
agagtattccatttttactat

SEQ ID NO: 1327 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
atagtaaaaatggaatactctcc

SEQ ID NO: 1328 - RNA, 23 nt, synthetic construct
  misc_feature 1..23: note = Synthetic
  source 1..23: mol_type = other RNA
caagagtattccatttttactaa

SEQ ID NO: 1329 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 7: mod_base = OTHER; note = 2'-fluorouridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2`-deoxyadenosine-3`-phosphate
  modified_base 21: mod_base = OTHER; note = L96
  source 1..21: mol_type = other RNA
agagtattccatttttactat

SEQ ID NO: 1330 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2`-deoxyadenosine-3`-phosphate
  modified_base 16: mod_base = OTHER; note = 2'-fluorouridine-3'-phosphate
  modified_base 21: mod_base = OTHER; note = 2'-O-methyluridine-3'- phosphorothioate
  modified_base 22: mod_base = OTHER; note = 2'-O-methylcytidine-3'- phosphorothioate
  source 1..23: mol_type = other RNA
atagtaaaaatggaatactctcc

SEQ ID NO: 1331 - RNA, 23 nt, synthetic construct
  misc_feature 1..23: note = Synthetic
  source 1..23: mol_type = other RNA
caagagtattccatttttactaa

SEQ ID NO: 1332 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 5: mod_base = OTHER; note = 2'-fluorouridine-3'-phosphate
  modified_base 7: mod_base = OTHER; note = 2'-fluorocytidine-3'-phosphate
  modified_base 8: mod_base = OTHER; note = 2'-fluorocytidine-3'-phosphate
  modified_base 9: mod_base = OTHER; note = 2`-deoxyadenosine-3`-phosphate
  modified_base 19: mod_base = OTHER; note = L96
  source 1..19: mol_type = other RNA
agtattccatttttactat

SEQ ID NO: 1333 - RNA, 21 nt, synthetic construct
  modified_base 5: mod_base = OTHER; note = thymine
  misc_feature 1..21: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2'-fluoroadenosine-3'-phosphate
  modified_base 16: mod_base = OTHER; note = 2'-fluorouridine-3'-phosphate
  modified_base 19: mod_base = OTHER; note = 2'-O-methyluridine-3'- phosphorothioate
  modified_base 20: mod_base = OTHER; note = 2'-O-methylcytidine-3'- phosphorothioate
  source 1..21: mol_type = other RNA
atagtaaaaatggaatactct

SEQ ID NO: 1334 - RNA, 21 nt, synthetic construct
  misc_feature 1..21: note = Synthetic
  source 1..21: mol_type = other RNA
agagtattccatttttactaa

SEQ ID NO: 1335 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 5: mod_base = OTHER; note = 2'-fluorouridine-3'-phosphate
  modified_base 7: mod_base = OTHER; note = 2'-fluorocytidine-3'-phosphate
  modified_base 8: mod_base = OTHER; note = 2'-fluorocytidine-3'-phosphate
  modified_base 9: mod_base = OTHER; note = 2`-deoxyadenosine-3`-phosphate
  modified_base 19: mod_base = OTHER; note = L96
  source 1..19: mol_type = other RNA
agtattccatttttactat

SEQ ID NO: 1336 - RNA, 21 nt, synthetic construct
  modified_base 5: mod_base = OTHER; note = thymine
  misc_feature 1..21: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = Adenosine-glycol nucleic acid
  modified_base 14: mod_base = OTHER; note = 2`-deoxyadenosine-3`-phosphate
  modified_base 16: mod_base = OTHER; note = 2'-fluorouridine-3'-phosphate
  modified_base 19: mod_base = OTHER; note = 2'-O-methyluridine-3'- phosphorothioate
  modified_base 20: mod_base = OTHER; note = 2'-O-methylcytidine-3'- phosphorothioate
  source 1..21: mol_type = other RNA
atagtaaaaatggaatactct

SEQ ID NO: 1337 - RNA, 21 nt, synthetic construct
  misc_feature 1..21: note = Synthetic
  source 1..21: mol_type = other RNA
agagtattccatttttactaa

SEQ ID NO: 1338 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 5: mod_base = OTHER; note = 2'-fluorouridine-3'-phosphate
  modified_base 7: mod_base = OTHER; note = 2'-fluorocytidine-3'-phosphate
  modified_base 8: mod_base = OTHER; note = 2'-fluorocytidine-3'-phosphate
  modified_base 9: mod_base = OTHER; note = 2`-deoxyadenosine-3`-phosphate
  modified_base 19: mod_base = OTHER; note = L96
  source 1..19: mol_type = other RNA
agtattccatttttactat

SEQ ID NO: 1339 - RNA, 21 nt, synthetic construct
  modified_base 5: mod_base = OTHER; note = thymine
  misc_feature 1..21: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 19: mod_base = OTHER; note = 2'-O-methyluridine-3'- phosphorothioate
  modified_base 20: mod_base = OTHER; note = 2'-O-methylcytidine-3'- phosphorothioate
  source 1..21: mol_type = other RNA
atagtaaaaatggaatactct

SEQ ID NO: 1340 - RNA, 21 nt, synthetic construct
  misc_feature 1..21: note = Synthetic
  source 1..21: mol_type = other RNA
agagtattccatttttactaa

SEQ ID NO: 1341 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methylguanosine-3'-phosphorothioate
  modified_base 5: mod_base = OTHER; note = 2'-fluorouridine-3'-phosphate
  modified_base 7: mod_base = OTHER; note = 2'-fluorocytidine-3'-phosphate
  modified_base 8: mod_base = OTHER; note = 2'-fluorocytidine-3'-phosphate
  modified_base 9: mod_base = OTHER; note = 2`-deoxyadenosine-3`-phosphate
  modified_base 19: mod_base = OTHER; note = L96
  source 1..19: mol_type = other RNA
agtattccatttttactat

SEQ ID NO: 1342 - RNA, 21 nt, synthetic construct
  modified_base 5: mod_base = OTHER; note = thymine
  misc_feature 1..21: note = Synthetic
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2`-deoxyadenosine-3`-phosphate
  modified_base 16: mod_base = OTHER; note = 2'-fluorouridine-3'-phosphate
  modified_base 19: mod_base = OTHER; note = 2'-O-methyluridine-3'- phosphorothioate
  modified_base 20: mod_base = OTHER; note = 2'-O-methylcytidine-3'- phosphorothioate
  source 1..21: mol_type = other RNA
atagtaaaaatggaatactct

SEQ ID NO: 1343 - RNA, 21 nt, synthetic construct
  misc_feature 1..21: note = Synthetic
  source 1..21: mol_type = other RNA
agagtattccatttttactaa

SEQ ID NO: 1344 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ctaaagcagtgttttcaccta

SEQ ID NO: 1345 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
taggtgaaaacactgctttagta

SEQ ID NO: 1346 - RNA, 23 nt, synthetic construct
  misc_feature 1..23: note = Synthetic
  source 1..23: mol_type = other RNA
tactaaagcagtgttttcacctc

SEQ ID NO: 1347 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2`-deoxyguanosine-3`-phosphate
  modified_base 21: mod_base = OTHER; note = L96
  source 1..21: mol_type = other RNA
ctaaagcagtgttttcaccta

SEQ ID NO: 1348 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
taggtgaaaacactgctttagta

SEQ ID NO: 1349 - RNA, 23 nt, synthetic construct
  misc_feature 1..23: note = Synthetic
  source 1..23: mol_type = other RNA
tactaaagcagtgttttcacctc

SEQ ID NO: 1350 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2`-deoxyguanosine-3`-phosphate
  modified_base 11: mod_base = OTHER; note = 2`-deoxyguanosine-3`-phosphate
  modified_base 12: mod_base = OTHER; note = 2'-fluorouridine-3'-phosphate
  modified_base 21: mod_base = OTHER; note = L96
  source 1..21: mol_type = other RNA
ctaaagcagtgttttcaccta

SEQ ID NO: 1351 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
taggtgaaaacactgctttagta

SEQ ID NO: 1352 - RNA, 23 nt, synthetic construct
  misc_feature 1..23: note = Synthetic
  source 1..23: mol_type = other RNA
tactaaagcagtgttttcacctc

SEQ ID NO: 1353 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ctaaagcagtgttttcacctt

SEQ ID NO: 1354 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
aaggtgaaaacactgctttagta

SEQ ID NO: 1355 - RNA, 23 nt, synthetic construct
  misc_feature 1..23: note = Synthetic
  source 1..23: mol_type = other RNA
tactaaagcagtgttttcacctc

SEQ ID NO: 1356 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ctaaagcagtgttttcaccta

SEQ ID NO: 1357 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyluridine-3'- phosphorothioate
  modified_base 2: mod_base = OTHER; note = 2`-deoxyadenosine-3`-phosphate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
taggtgaaaacactgctttagta

SEQ ID NO: 1358 - RNA, 23 nt, synthetic construct
  misc_feature 1..23: note = Synthetic
  source 1..23: mol_type = other RNA
tactaaagcagtgttttcacctc

SEQ ID NO: 1359 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ctaaagcagtgttttcaccta

SEQ ID NO: 1360 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  source 1..23: mol_type = other RNA
taggtgaaaacactgctttagcc

SEQ ID NO: 1361 - RNA, 23 nt, synthetic construct
  misc_feature 1..23: note = Synthetic
  source 1..23: mol_type = other RNA
tactaaagcagtgttttcacctc

SEQ ID NO: 1362 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 5: mod_base = OTHER; note = 2'-fluorocytidine-3'-phosphate
  modified_base 7: mod_base = OTHER; note = 2'-fluoroguanosine-3'-phosphate
  modified_base 8: mod_base = OTHER; note = 2'-fluorouridine-3'-phosphate
  modified_base 9: mod_base = OTHER; note = 2'-fluoroguanosine-3'-phosphate
  modified_base 19: mod_base = OTHER; note = L96
  source 1..19: mol_type = other RNA
aaagcagtgttttcaccta

SEQ ID NO: 1363 - RNA, 21 nt, synthetic construct
  modified_base 5: mod_base = OTHER; note = thymine
  misc_feature 1..21: note = Synthetic
  modified_base 1: mod_base = OTHER; note = 2'-O-methyluridine-3'- phosphorothioate
  modified_base 2: mod_base = OTHER; note = 2'-fluoroadenosine-3'-phosphorothioate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19: mod_base = OTHER; note = 2'-O-methyluridine-3'- phosphorothioate
  modified_base 20: mod_base = OTHER; note = 2'-O-methyladenosine-3'- phosphorothioate
  source 1..21: mol_type = other RNA
taggtgaaaacactgctttag

SEQ ID NO: 1364 - RNA, 21 nt, synthetic construct
  misc_feature 1..21: note = Synthetic
  source 1..21: mol_type = other RNA
ctaaagcagtgttttcacctc

SEQ ID NO: 1365 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2`-deoxyguanosine-3`-phosphate
  modified_base 21: mod_base = OTHER; note = L96
  source 1..21: mol_type = other RNA
ctaaagcagtgttttcaccta

SEQ ID NO: 1366 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
aaggtgaaaacactgctttagta

SEQ ID NO: 1367 - RNA, 23 nt, synthetic construct
  misc_feature 1..23: note = Synthetic
  source 1..23: mol_type = other RNA
tactaaagcagtgttttcacctc

SEQ ID NO: 1368 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2`-deoxyguanosine-3`-phosphate
  modified_base 11: mod_base = OTHER; note = 2`-deoxyguanosine-3`-phosphate
  modified_base 12: mod_base = OTHER; note = 2'-fluorouridine-3'-phosphate
  modified_base 21: mod_base = OTHER; note = L96
  source 1..21: mol_type = other RNA
ctaaagcagtgttttcaccta

SEQ ID NO: 1369 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'- phosphorothioate
  source 1..23: mol_type = other RNA
aaggtgaaaacactgctttagta

SEQ ID NO: 1370 - RNA, 23 nt, synthetic construct
  misc_feature 1..23: note = Synthetic
  source 1..23: mol_type = other RNA
tactaaagcagtgttttcacctc

SEQ ID NO: 1371 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2`-deoxyguanosine-3`-phosphate
  modified_base 21: mod_base = OTHER; note = L96
  source 1..21: mol_type = other RNA
ctaaagcagtgttttcaccta

SEQ ID NO: 1372 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  source 1..23: mol_type = other RNA
aaggtgaaaacactgctttagcc

SEQ ID NO: 1373 - RNA, 23 nt, synthetic construct
  misc_feature 1..23: note = Synthetic
  source 1..23: mol_type = other RNA
tactaaagcagtgttttcacctc

SEQ ID NO: 1374 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 7: mod_base = OTHER; note = 2'-fluorocytidine-3'-phosphate
  modified_base 9: mod_base = OTHER; note = 2`-deoxyguanosine-3`-phosphate
  modified_base 11: mod_base = OTHER; note = 2`-deoxyguanosine-3`-phosphate
  modified_base 12: mod_base = OTHER; note = 2'-fluorouridine-3'-phosphate
  modified_base 21: mod_base = OTHER; note = L96
  source 1..21: mol_type = other RNA
ctaaagcagtgttttcaccta

SEQ ID NO: 1375 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  source 1..23: mol_type = other RNA
aaggtgaaaacactgctttagcc

SEQ ID NO: 1376 - RNA, 23 nt, synthetic construct
  misc_feature 1..23: note = Synthetic
  source 1..23: mol_type = other RNA
tactaaagcagtgttttcacctc

SEQ ID NO: 1377 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 5: mod_base = OTHER; note = 2'-fluorocytidine-3'-phosphate
  modified_base 8: mod_base = OTHER; note = 2'-fluorouridine-3'-phosphate
  modified_base 9: mod_base = OTHER; note = 2`-deoxyguanosine-3`-phosphate
  modified_base 19: mod_base = OTHER; note = L96
  source 1..19: mol_type = other RNA
aaagcagtgttttcaccta

SEQ ID NO: 1378 - RNA, 21 nt, synthetic construct
  modified_base 5: mod_base = OTHER; note = thymine
  misc_feature 1..21: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19: mod_base = OTHER; note = 2'-O-methyluridine-3'- phosphorothioate
  modified_base 20: mod_base = OTHER; note = 2'-O-methyladenosine-3'- phosphorothioate
  source 1..21: mol_type = other RNA
aaggtgaaaacactgctttag

SEQ ID NO: 1379 - RNA, 21 nt, synthetic construct
  misc_feature 1..21: note = Synthetic
  source 1..21: mol_type = other RNA
ctaaagcagtgttttcacctc

SEQ ID NO: 1380 - RNA, 19 nt, synthetic construct
  misc_feature 1..19: note = Synthetic
  modified_base 1: mod_base = OTHER; note = 2'-O-methyladenosine-3'- phosphorothioate
  modified_base 2: mod_base = OTHER; note = 2'-O-methyladenosine-3'-phosphorothioate
  modified_base 5: mod_base = OTHER; note = 2'-fluorocytidine-3'-phosphate
  modified_base 7: mod_base = OTHER; note = 2`-deoxyguanosine-3`-phosphate
  modified_base 9: mod_base = OTHER; note = 2`-deoxyguanosine-3`-phosphate
  modified_base 10: mod_base = OTHER; note = 2'-fluorouridine-3'-phosphate
  modified_base 19: mod_base = OTHER; note = L96
  source 1..19: mol_type = other RNA
aaagcagtgttttcaccta

SEQ ID NO: 1381 - RNA, 21 nt, synthetic construct
  modified_base 5: mod_base = OTHER; note = thymine
  misc_feature 1..21: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphate
  modified_base 5: mod_base = OTHER; note = 2`-deoxythimidine -3`-phosphate
  modified_base 7: mod_base = OTHER; note = adenosine-2`-phosphate
  modified_base 14: mod_base = OTHER; note = 2'-fluorouridine-3'-phosphate
  modified_base 16: mod_base = OTHER; note = 2'-fluorocytidine-3'-phosphate
  modified_base 19: mod_base = OTHER; note = 2'-O-methyluridine-3'- phosphorothioate
  modified_base 20: mod_base = OTHER; note = 2'-O-methyladenosine-3'- phosphorothioate
  source 1..21: mol_type = other RNA
aaggtgaaaacactgctttag

SEQ ID NO: 1382 - RNA, 21 nt, synthetic construct
  misc_feature 1..21: note = Synthetic
  source 1..21: mol_type = other RNA
ctaaagcagtgttttcacctc

SEQ ID NO: 1383 - RNA, 21 nt, synthetic construct
  modified_base 20..21: mod_base = OTHER; note = thymine
  misc_feature 1..21: note = Synthetic
  modified_base 1: mod_base = OTHER; note = 2'-O-methylcytidine-3'-phosphate
  modified_base 2: mod_base = OTHER; note = 2'-O-methyluridine-3'-phosphate
  modified_base 3: mod_base = OTHER; note = 2'-O-methyluridine-3'-phosphate
  modified_base 4: mod_base = OTHER; note = Adenosine-3'-phosphate
  modified_base 5: mod_base = OTHER; note = 2'-O-methylcytidine-3'-phosphate
  modified_base 6: mod_base = OTHER; note = guanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = guanosine-3'-phosphate
  modified_base 10: mod_base = OTHER; note = Adenosine-3'-phosphate
  modified_base 11: mod_base = OTHER; note = guanosine-3'-phosphate
  modified_base 12: mod_base = OTHER; note = 2'-O-methyluridine-3'-phosphate
  modified_base 13: mod_base = OTHER; note = Adenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = guanosine-3'-phosphate
  modified_base 19: mod_base = OTHER; note = Adenosine-3'-phosphate
  modified_base 20: mod_base = OTHER; note = 2'-deoxythimidine-3'-phosphorothioate
  modified_base 21: mod_base = OTHER; note = 2'-deoxythimidine -3'-phosphate
  source 1..21: mol_type = other RNA
cttacgctgagtacttcgatt

SEQ ID NO: 1384 - RNA, 21 nt, synthetic construct
  modified_base 20..21: mod_base = OTHER; note = thymine
  misc_feature 1..21: note = Synthetic
  modified_base 1: mod_base = OTHER; note = Uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = Adenosine-3'-phosphate
  modified_base 5: mod_base = OTHER; note = Adenosine-3'-phosphate
  modified_base 6: mod_base = OTHER; note = guanosine-3'-phosphate
  modified_base 7: mod_base = OTHER; note = 2'-O-methyluridine-3'-phosphate
  modified_base 8: mod_base = OTHER; note = Adenosine-3'-phosphate
  modified_base 9: mod_base = OTHER; note = cytidine-3'-phosphate
  modified_base 10: mod_base = OTHER; note = Uridine-3'-phosphate
  modified_base 11: mod_base = OTHER; note = 2'-O-methylcytidine-3'-phosphate
  modified_base 12: mod_base = OTHER; note = Adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = 2'-O-methyluridine-3'-phosphate
  modified_base 17: mod_base = OTHER; note = Adenosine-3'-phosphate
  modified_base 18: mod_base = OTHER; note = Adenosine-3'-phosphate
  modified_base 19: mod_base = OTHER; note = guanosine-3'-phosphate
  modified_base 20: mod_base = OTHER; note = 2'-deoxythimidine-3'-phosphorothioate
  modified_base 21: mod_base = OTHER; note = 2'-deoxythimidine -3'-phosphate
  source 1..21: mol_type = other RNA
tcgaagtactcagcgtaagtt

SEQ ID NO: 1385 - RNA, 21 nt, synthetic construct
  misc_feature 1..21: note = Synthetic
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate
  source 1..21: mol_type = other RNA
tgggatttcatgtaaccaaga

SEQ ID NO: 1386 - RNA, 23 nt, synthetic construct
  misc_feature 1..23: note = Synthetic
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  source 1..23: mol_type = other RNA
tcttggttacatgaaatcccatc

We claim:

1. A double stranded ribonucleic acid (dsRNA) agent, or salt thereof, for inhibiting expression of transthyretin (TTR) in a cell,
   wherein the dsRNA agent comprises a sense strand and an antisense strand forming a double stranded region,
   wherein the nucleotide sequence of the sense strand differs by no more than 4 bases from the nucleotide sequence 5'-csasagagUfaUfUfCfcauuuuuacu-3' of SEQ ID NO: 21 and the nucleotide sequence of the antisense strand differs by no more than 4 bases from the nucleotide sequence 5'-asGfsuaaAfaauggaaUfaCfucuugsgsu-3' of SEQ ID NO: 22,
   wherein a, c, g, and u are 2'-O-methyl (2'-OMe) A, C, G, and U, respectively; Af, Cf, Gf and Uf are 2'-fluoro A, C, G and U, respectively; s is a phosphorothioate linkage, and wherein at least one strand is conjugated to a ligand.

2. The dsRNA agent, or salt thereof, of claim 1, wherein the nucleotide sequence of the sense strand differs by no more than 3 bases from the nucleotide sequence 5'-csasagagUfaUfUfCfcauuuuuacu-3' of SEQ ID NO: 21 and the nucleotide sequence of the antisense strand differs by no more than 3 bases from the nucleotide sequence 5'-asGfsuaaAfaauggaaUfaCfucuugsgsu-3' of SEQ ID NO: 22.

3. The dsRNA agent, or salt thereof, of claim 1, wherein the nucleotide sequence of the sense strand differs by no more than 2 bases from the nucleotide sequence 5'-csasagagUfaUfUfCfcauuuuuacu-3' of SEQ ID NO: 21 and the nucleotide sequence of the antisense strand differs by no more than 2 bases from the nucleotide sequence 5'-asGfsuaaAfaauggaaUfaCfucuugsgsu-3' of SEQ ID NO: 22.

4. The dsRNA agent, or salt thereof, of claim 1, wherein the nucleotide sequence of the sense strand differs by no more than 1 base from the nucleotide sequence 5'-csasagagUfaUfUfCfcauuuuuacu-3' of SEQ ID NO: 21 and the nucleotide sequence of the antisense strand differs by no more than 1 base from the nucleotide sequence 5'-asGfsuaaAfaauggaaUfaCfucuugsgsu-3' of SEQ ID NO: 22.

5. The dsRNA agent, or salt thereof, of claim 1, wherein the ligand is conjugated to the 3' end of the sense strand of the dsRNA agent.

6. The dsRNA agent, or salt thereof, of claim 1, wherein the ligand is an N-acetylgalactosamine (GalNAc) derivative.

7. The dsRNA agent, or salt thereof, of claim 1, wherein the ligand is one or more GalNAc derivatives attached through a monovalent, bivalent, or trivalent branched linker.

8. The dsRNA agent, or salt thereof, of claim 7, wherein the ligand is

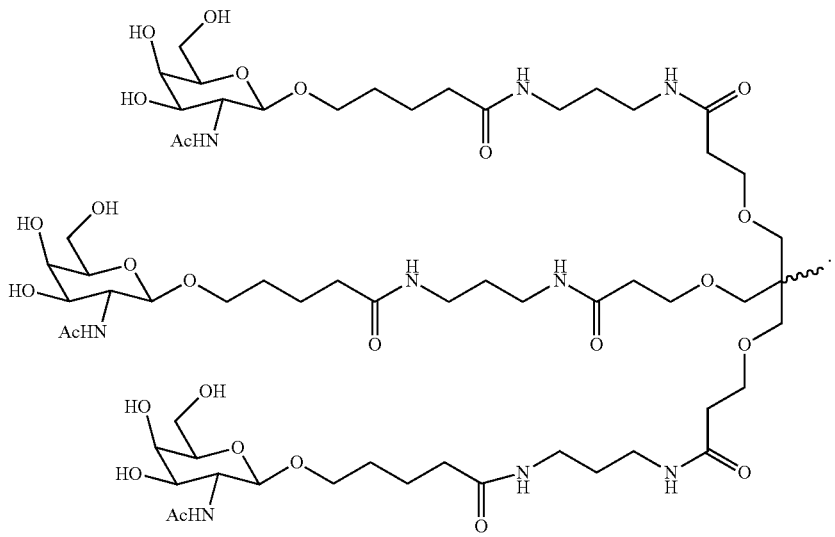 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

9. The dsRNA agent, or salt thereof, of claim 8, wherein the dsRNA agent is conjugated to the ligand as shown in the following schematic

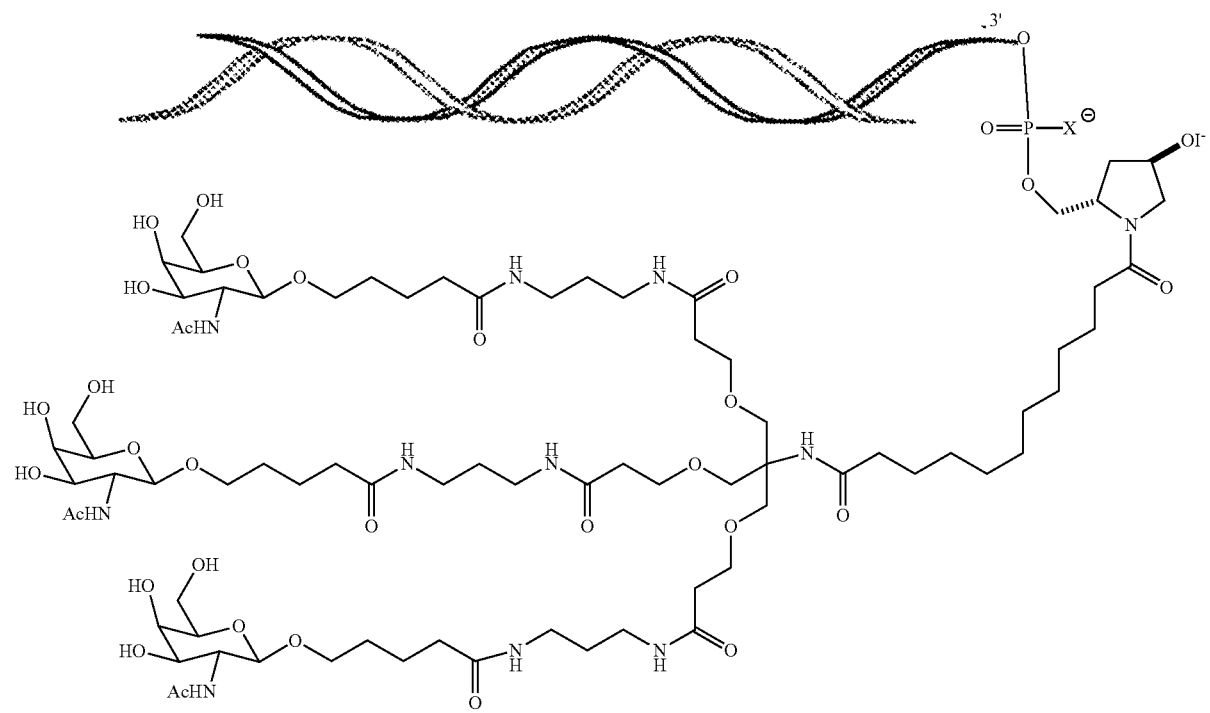

and, wherein X is O or S.

10. The dsRNA agent, or salt thereof, of claim 9, wherein the X is O.

11. A double stranded ribonucleic acid (dsRNA) agent, or salt thereof, for inhibiting expression of transthyretin (TTR) in a cell,
wherein the dsRNA agent comprises a sense strand and an antisense strand forming a double stranded region,
wherein the sense strand comprises the nucleotide sequence 5'-csasagagUfaUfUfCfcauuuuuacu-3' of SEQ ID NO: 21 and the antisense strand comprises the nucleotide sequence 5'-asGfsuaaAfaauggaaUfaCfuc-uugsgsu-3' of SEQ ID NO: 22,
wherein a, c, g, and u are 2'-O-methyl (2'-OMe) A, C, G, and U, respectively; Af, Cf, Gf and Uf are 2'-fluoro A, C, G and U, respectively; s is a phosphorothioate linkage, and wherein at least one strand is conjugated to a ligand.

12. The dsRNA agent, or salt thereof, of claim 11, wherein the sense strand consists of the nucleotide sequence 5'-csasagagUfaUfUfCfcauuuuuacu-3' of SEQ ID NO: 21 and the antisense strand consists of the nucleotide sequence 5'-asGfsuaaAfaauggaaUfaCfucuugsgsu-3' of SEQ ID NO: 22.

13. The dsRNA agent, or salt thereof, of claim 11, wherein the ligand is conjugated to the 3' end of the sense strand of the dsRNA agent.

14. The dsRNA agent, or salt thereof, of claim 11, wherein the ligand is an N-acetylgalactosamine (GalNAc) derivative.

15. The dsRNA agent, or salt thereof, of claim 11, wherein the ligand is one or more GalNAc derivatives attached through a monovalent, bivalent, or trivalent branched linker.

16. The dsRNA agent, or salt thereof, of claim 15, wherein the ligand is

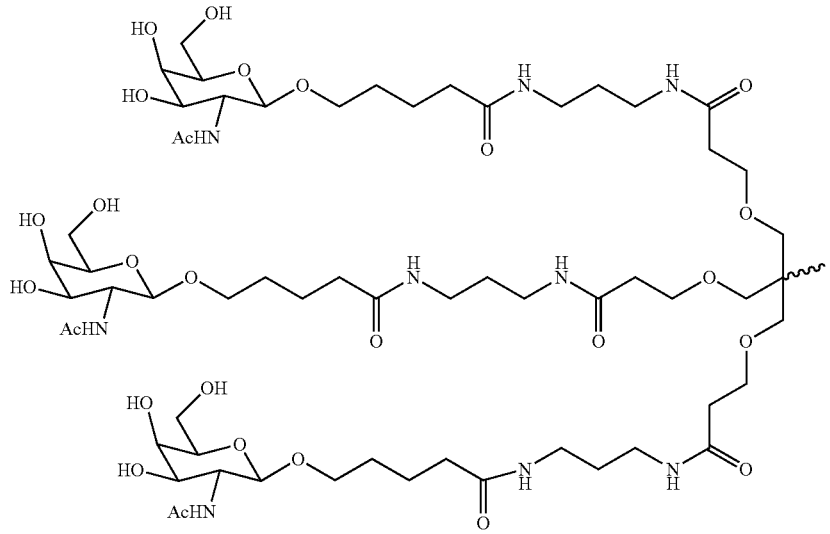

17. The dsRNA agent, or salt thereof, of claim 16, wherein the dsRNA agent is conjugated to the ligand as shown in the following schematic

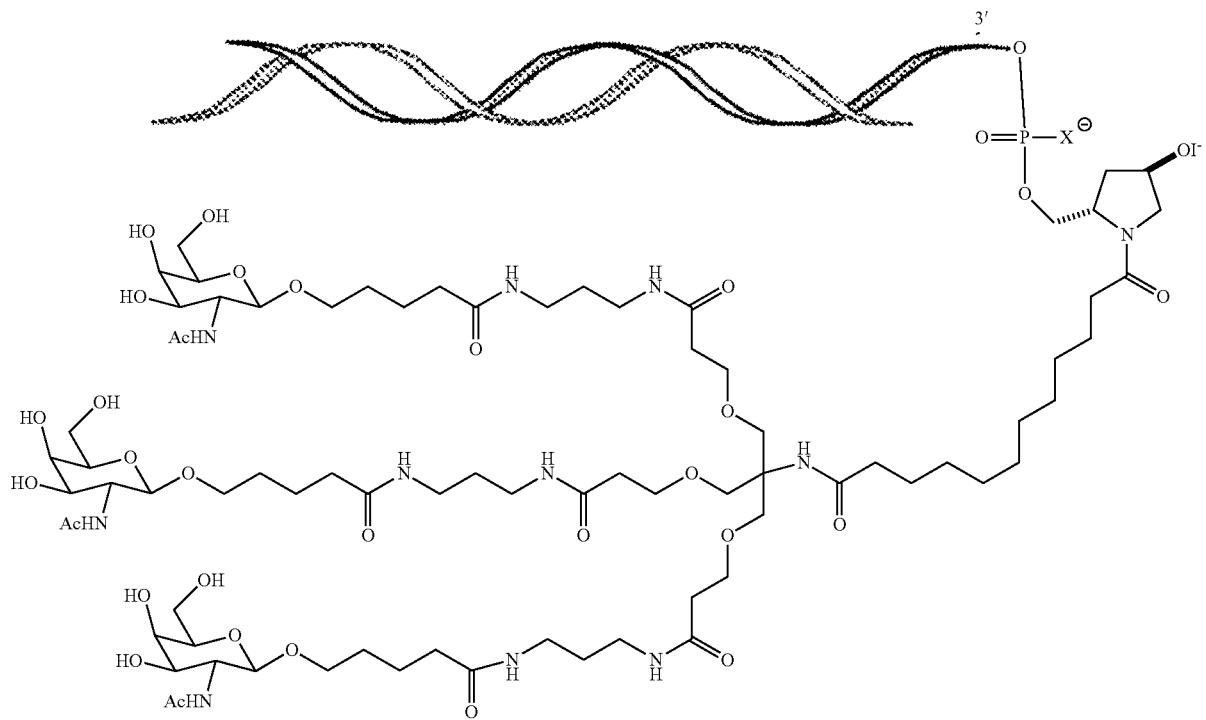

and, wherein X is O or S.

18. The dsRNA agent, or salt thereof, of claim 17, wherein X is O.

19. A double stranded ribonucleic acid (dsRNA) agent, or salt thereof, for inhibiting expression of transthyretin (TTR) in a cell,
   wherein the dsRNA agent comprises a sense strand and an antisense strand forming a double stranded region,
   wherein the sense strand comprises the nucleotide sequence 5'-csasagagUfaUfUfCfcauuuuuacu-3' of SEQ ID NO: 21 and the antisense strand comprises the nucleotide sequence 5'-asGfsuaaAfaauggaaUfaCfucuugsgsu-3' of SEQ ID NO: 22,
   wherein a, c, g, and u are 2'-O-methyl (2'-OMe) A, C, G, and U, respectively; Af, Cf, Gf and Uf are 2'-fluoro A, C, G and U, respectively; s is a phosphorothioate linkage, and wherein the dsRNA agent is conjugated to a ligand as shown in the following schematic

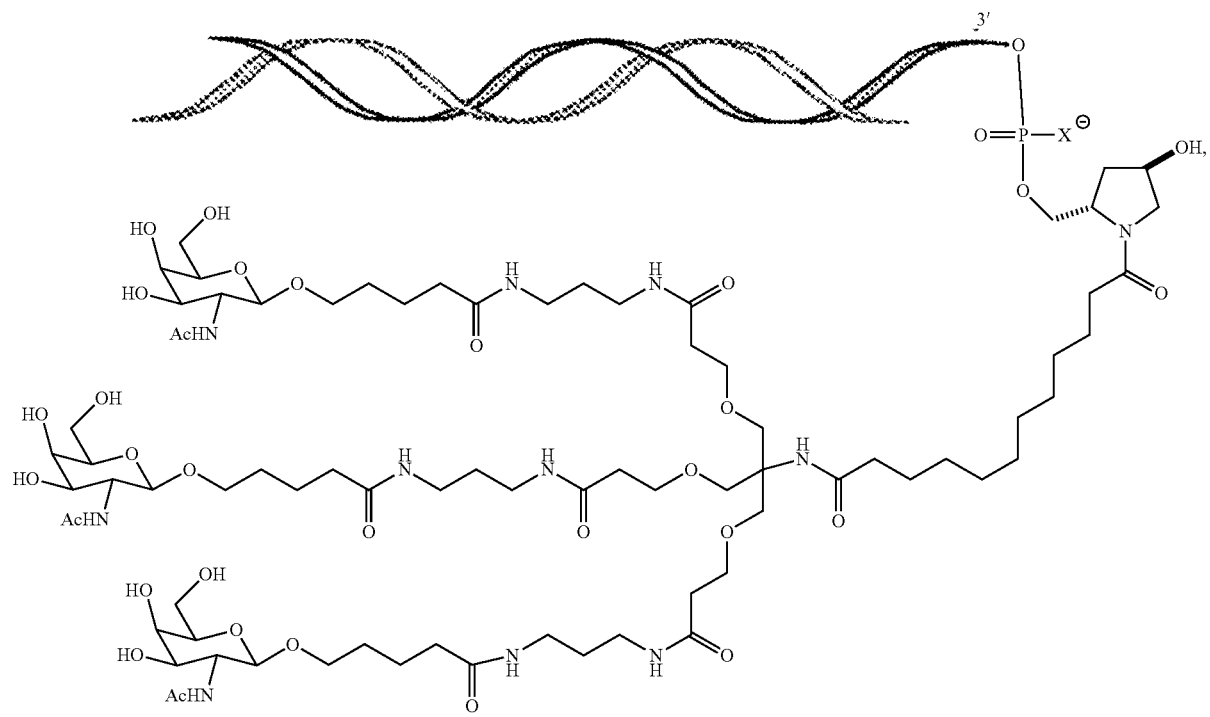

wherein X is O.

20. The dsRNA agent, or salt thereof, of claim 19, wherein the sense strand consists of the nucleotide sequence 5'-csasagagUfaUfUfCfcauuuuuacu-3' of SEQ ID NO: 21 and the antisense strand consists of the nucleotide sequence 5'-asGfsuaaAfaauggaaUfaCfucuugsgsu-3' of SEQ ID NO: 22.

21. A cell containing the dsRNA agent, or salt thereof, of claim 1.

22. A pharmaceutical composition for inhibiting expression of a gene encoding transthyretin (TTR) comprising the dsRNA agent, or salt thereof, of claim 1 and a pharmaceutically acceptable carrier.

23. The pharmaceutical composition of claim 22, wherein dsRNA agent, or salt thereof, is in an unbuffered solution.

24. The pharmaceutical composition of claim 23, wherein the unbuffered solution is saline or water.

25. The pharmaceutical composition of claim 22, wherein the dsRNA agent, or salt thereof, is in a buffer solution.

26. The pharmaceutical composition of claim 25, wherein the buffer solution comprises acetate, citrate, prolamine, carbonate, or phosphate or any combination thereof.

27. The pharmaceutical composition of claim 25, wherein the buffer solution is phosphate buffered saline (PBS).

28. The pharmaceutical composition of claim 22, wherein dsRNA agent is in a salt form.

29. The pharmaceutical composition of claim 22, wherein dsRNA agent is in a sodium salt form.

30. The pharmaceutical composition of claim 22, wherein dsRNA agent is in a free acid form.

* * * * *